US009416363B2

(12) United States Patent
Ader et al.

(10) Patent No.: US 9,416,363 B2
(45) Date of Patent: Aug. 16, 2016

(54) METHODS AND COMPOSITIONS FOR WEED CONTROL

(75) Inventors: Daniel Ader, St. Louis, MO (US); John J Finnessy, Des Peres, MO (US); Zhaolong Li, St. Charles, MO (US); Mahak Kapoor, Chesterfield, MO (US); Ronak Hasmukh Shah, Jamaica, NY (US); Nengbing Tao, O'Fallon, MO (US); Dafu Wang, Chesterfield, MO (US)

(73) Assignee: Monsanto Technology LLC, St. Louis, MO (US)

( * ) Notice: Subject to any disclaimer, the term of this patent is extended or adjusted under 35 U.S.C. 154(b) by 763 days.

(21) Appl. No.: 13/612,985

(22) Filed: Sep. 13, 2012

(65) Prior Publication Data

US 2013/0254941 A1 Sep. 26, 2013

Related U.S. Application Data

(60) Provisional application No. 61/534,086, filed on Sep. 13, 2011.

(51) Int. Cl.

| | |
|---|---|
| *C12N 15/82* | (2006.01) |
| *A01N 57/16* | (2006.01) |
| *C12N 15/113* | (2010.01) |
| *A01H 3/04* | (2006.01) |
| *C12N 9/02* | (2006.01) |

(Continued)

(52) U.S. Cl.
CPC .............. *C12N 15/1137* (2013.01); *A01H 3/04* (2013.01); *A01N 41/06* (2013.01); *A01N 43/84* (2013.01); *A01N 57/16* (2013.01); *C12N 9/001* (2013.01); *C12N 15/8218* (2013.01); *C12N 15/8243* (2013.01); *C12N 15/8274* (2013.01); *C12Y 103/03004* (2013.01)

(58) Field of Classification Search
CPC .. C12N 15/113; C12N 15/8218; A01N 57/16; A01N 41/06
See application file for complete search history.

(56) References Cited

U.S. PATENT DOCUMENTS

| | | | |
|---|---|---|---|
| 3,687,808 | A | 8/1972 | Merigan et al. |
| 3,791,932 | A | 2/1974 | Schuurs et al. |

(Continued)

FOREIGN PATENT DOCUMENTS

| | | | |
|---|---|---|---|
| CN | 101279950 | A | 10/2008 |
| CN | 101279951 | A | 10/2008 |

(Continued)

OTHER PUBLICATIONS

Clough, Steven J., and Andrew F. Bent. "Floral dip: a simplified method forAgrobacterium-mediated transformation of*Arabidopsis thaliana*." The plant journal 16.6 (1998): 735-743.*

(Continued)

*Primary Examiner* — Russell Kallis
*Assistant Examiner* — Weihua Fan
(74) *Attorney, Agent, or Firm* — Amanda Carmany-Rampey; David R. Marsh; Arnold & Porter LLP

(57) ABSTRACT

Novel compositions for use to enhance weed control. Specifically, the present invention provides for methods and compositions that modulate protoporphyrinogen IX oxidase in weed species. The present invention also provides for combinations of compositions and methods that enhance weed control.

29 Claims, 3 Drawing Sheets

(51) Int. Cl.
*A01N 41/06* (2006.01)
*A01N 43/84* (2006.01)

(56) References Cited

U.S. PATENT DOCUMENTS 3,839,153 A 10/1974 Schuurs et al.
3,850,578 A 11/1974 McConnell
3,850,752 A 11/1974 Schuurs et al.
3,853,987 A 12/1974 Dreyer
3,867,517 A 2/1975 Ling
3,879,262 A 4/1975 Schuurs et al.
3,901,654 A 8/1975 Gross
3,935,074 A 1/1976 Rubenstein et al.
3,984,533 A 10/1976 Uzgiris
3,996,345 A 12/1976 Ullman et al.
4,034,074 A 7/1977 Miles
4,098,876 A 7/1978 Piasio et al.
4,469,863 A 9/1984 Ts'o et al.
4,476,301 A 10/1984 Imbach et al.
4,535,060 A 8/1985 Comai
4,581,847 A 4/1986 Hibberd et al.
4,666,828 A 5/1987 Gusella
4,683,202 A 7/1987 Mullis
4,761,373 A 8/1988 Anderson et al.
4,769,061 A 9/1988 Comai
4,801,531 A 1/1989 Frossard
4,810,648 A 3/1989 Stalker
4,879,219 A 11/1989 Wands et al.
4,940,835 A 7/1990 Shah et al.
4,971,908 A 11/1990 Kishore et al.
5,004,863 A 4/1991 Umbeck
5,011,771 A 4/1991 Bellet et al.
5,013,659 A 5/1991 Bedbrook et al.
5,015,580 A 5/1991 Christou et al.
5,023,243 A 6/1991 Tullis
5,034,506 A 7/1991 Summerton et al.
5,094,945 A 3/1992 Comai
5,141,870 A 8/1992 Bedbrook et al.
5,145,783 A 9/1992 Kishore et al.
5,159,135 A 10/1992 Umbeck
5,166,315 A 11/1992 Summerton et al.
5,177,196 A 1/1993 Meyer, Jr. et al.
5,185,444 A 2/1993 Summerton et al.
5,188,642 A 2/1993 Shah et al.
5,188,897 A 2/1993 Suhadolnik et al.
5,192,659 A 3/1993 Simons
5,214,134 A 5/1993 Weis et al.
5,216,141 A 6/1993 Benner
5,235,033 A 8/1993 Summerton et al.
5,264,423 A 11/1993 Cohen et al.
5,264,562 A 11/1993 Matteucci
5,264,564 A 11/1993 Matteucci
5,272,057 A 12/1993 Smulson et al.
5,276,019 A 1/1994 Cohen et al.
5,281,521 A 1/1994 Trojanowski et al.
5,286,717 A 2/1994 Cohen et al.
5,304,732 A 4/1994 Anderson et al.
5,310,667 A 5/1994 Eichholtz et al.
5,312,910 A 5/1994 Kishore et al.
5,321,131 A 6/1994 Agrawal et al.
5,331,107 A 7/1994 Anderson et al.
5,339,107 A 8/1994 Henry et al.
5,346,107 A 9/1994 Bouix et al.
5,378,824 A 1/1995 Bedbrook et al.
5,390,667 A 2/1995 Kumakura et al.
5,392,910 A 2/1995 Bell et al.
5,393,175 A 2/1995 Courville
5,399,676 A 3/1995 Froehler
5,405,938 A 4/1995 Summerton et al.
5,405,939 A 4/1995 Suhadolnik et al.
5,416,011 A 5/1995 Hinchee et al.
5,453,496 A 9/1995 Caruthers et al.
5,455,233 A 10/1995 Spielvogel et al.
5,460,667 A 10/1995 Moriyuki et al.
5,462,910 A 10/1995 Ito et al.
5,463,174 A 10/1995 Moloney et al.
5,463,175 A 10/1995 Barry et al.
5,466,677 A 11/1995 Baxter et al.
5,470,967 A 11/1995 Huie et al.
5,476,925 A 12/1995 Letsinger et al.
5,489,520 A 2/1996 Adams et al.
5,489,677 A 2/1996 Sanghvi et al.
5,491,288 A 2/1996 Chaubet et al.
5,510,471 A 4/1996 Lebrun et al.
5,518,908 A 5/1996 Corbin et al.
5,519,126 A 5/1996 Hecht
5,536,821 A 7/1996 Agrawal et al.
5,538,880 A 7/1996 Lundquist et al.
5,541,306 A 7/1996 Agrawal et al.
5,541,307 A 7/1996 Cook et al.
5,550,111 A 8/1996 Suhadolnik et al.
5,550,318 A 8/1996 Adams et al.
5,550,398 A 8/1996 Kocian et al.
5,550,468 A 8/1996 Häberlein et al.
5,558,071 A 9/1996 Ward et al.
5,561,225 A 10/1996 Maddry et al.
5,561,236 A 10/1996 Leemans et al.
5,563,253 A 10/1996 Agrawal et al.
5,569,834 A 10/1996 Hinchee et al.
5,571,799 A 11/1996 Tkachuk et al.
5,587,361 A 12/1996 Cook et al.
5,591,616 A 1/1997 Hiei et al.
5,593,874 A 1/1997 Brown et al.
5,596,086 A 1/1997 Matteucci et al.
5,602,240 A 2/1997 De Mesmaeker et al.
5,605,011 A 2/1997 Bedbrook et al.
5,608,046 A 3/1997 Cook et al.
5,610,289 A 3/1997 Cook et al.
5,618,704 A 4/1997 Sanghvi et al.
5,623,070 A 4/1997 Cook et al.
5,625,050 A 4/1997 Beaton et al.
5,627,061 A 5/1997 Barry et al.
5,633,360 A 5/1997 Bischofberger et al.
5,633,435 A 5/1997 Barry et al.
5,633,448 A 5/1997 Lebrun et al.
5,639,024 A 6/1997 Mueller et al.
5,646,024 A 7/1997 Leemans et al.
5,648,477 A 7/1997 Leemans et al.
5,663,312 A 9/1997 Chaturvedula
5,677,437 A 10/1997 Teng et al.
5,677,439 A 10/1997 Weis et al.
5,719,046 A 2/1998 Guerineau et al.
5,721,138 A 2/1998 Lawn
5,731,180 A 3/1998 Dietrich
5,739,180 A 4/1998 Taylor-Smith
5,746,180 A 5/1998 Jefferson et al.
5,767,361 A 6/1998 Dietrich
5,767,373 A 6/1998 Ward et al.
5,780,708 A 7/1998 Lundquist et al.
5,804,425 A 9/1998 Barry et al.
5,824,877 A 10/1998 Hinchee et al.
5,837,848 A 11/1998 Ely et al.
5,859,347 A 1/1999 Brown et al.
5,866,775 A 2/1999 Eichholtz et al.
5,874,265 A 2/1999 Adams et al.
5,879,903 A 3/1999 Strauch et al.
5,914,451 A 6/1999 Martinell et al.
5,919,675 A 7/1999 Adams et al.
5,928,937 A 7/1999 Kakefuda et al.
5,939,602 A 8/1999 Volrath et al.
5,969,213 A 10/1999 Adams et al.
5,981,840 A 11/1999 Zhao et al.
5,985,793 A * 11/1999 Sandbrink .............. A01N 25/00
424/405
RE36,449 E 12/1999 Lebrun et al.
6,040,497 A 3/2000 Spencer et al.
6,056,938 A 5/2000 Unger et al.
6,069,115 A 5/2000 Pallett et al.
6,084,089 A 7/2000 Mine et al.
6,084,155 A 7/2000 Volrath et al.
6,118,047 A 9/2000 Anderson et al.
6,121,513 A 9/2000 Zhang et al.
6,130,366 A 10/2000 Herrera-Estrella et al.
6,140,078 A 10/2000 Sanders et al.

(56) References Cited

U.S. PATENT DOCUMENTS 6,153,812 A 11/2000 Fry et al.
6,160,208 A 12/2000 Lundquist et al.
6,177,616 B1 1/2001 Bartsch et al.
6,194,636 B1 2/2001 McElroy et al.
6,225,105 B1 5/2001 Sathasivan et al.
6,225,114 B1 5/2001 Eichholtz et al.
6,232,526 B1 5/2001 McElroy et al.
6,245,968 B1 6/2001 Boudec et al.
6,248,876 B1 6/2001 Barry et al.
6,252,138 B1 6/2001 Karimi et al.
RE37,287 E 7/2001 Lebrun et al.
6,268,549 B1 7/2001 Sailland et al.
6,271,359 B1 8/2001 Norris et al.
6,282,837 B1 9/2001 Ward et al.
6,288,306 B1 9/2001 Ward et al.
6,288,312 B1 9/2001 Christou et al.
6,294,714 B1 9/2001 Matsunaga et al.
6,326,193 B1 12/2001 Liu et al.
6,329,571 B1 12/2001 Hiei
6,348,185 B1 2/2002 Piwnica-Worms
6,365,807 B1 4/2002 Christou et al.
6,384,301 B1 5/2002 Martinell et al.
6,385,902 B1 5/2002 Schipper et al.
6,399,861 B1 6/2002 Anderson et al.
6,403,865 B1 6/2002 Koziel et al.
6,414,222 B1 7/2002 Gengenbach et al.
6,421,956 B1 7/2002 Boukens et al.
6,426,446 B1 7/2002 McElroy et al.
6,433,252 B1 8/2002 Kriz et al.
6,437,217 B1 8/2002 McElroy et al.
6,453,609 B1 9/2002 Soll et al.
6,642,435 B1 11/2003 Rafalski et al.
6,644,341 B1 11/2003 Chemo et al.
6,768,044 B1 7/2004 Boudec et al.
6,992,237 B1 1/2006 Habben et al.
7,022,896 B1 4/2006 Weeks et al.
7,026,528 B2 4/2006 Cheng et al.
RE39,247 E 8/2006 Barry et al.
7,105,724 B2 9/2006 Weeks et al.
7,297,541 B2 11/2007 Moshiri et al.
7,304,209 B2 12/2007 Zink et al.
7,312,379 B2 12/2007 Andrews et al.
7,323,310 B2 1/2008 Peters et al.
7,371,927 B2 5/2008 Yao et al.
7,392,379 B2 6/2008 Le Pennec et al.
7,405,347 B2 7/2008 Hammer et al.
7,406,981 B2 8/2008 Hemo et al.
7,462,379 B2 12/2008 Fukuda et al.
7,485,777 B2 2/2009 Nakajima et al.
7,525,013 B2 4/2009 Hildebrand et al.
7,550,578 B2 6/2009 Budworth et al.
7,622,301 B2 11/2009 Ren et al.
7,657,299 B2 2/2010 Huizenga et al.
7,671,254 B2 3/2010 Tranel et al.
7,714,188 B2 5/2010 Castle et al.
7,738,626 B2 6/2010 Weese et al.
7,807,791 B2 10/2010 Sekar et al.
7,838,263 B2 11/2010 Dam et al.
7,838,733 B2 11/2010 Wright et al.
7,842,856 B2 11/2010 Tranel et al.
7,884,262 B2 2/2011 Clemente et al.
7,910,805 B2 3/2011 Duck et al.
7,935,869 B2 5/2011 Pallett et al.
7,943,819 B2 5/2011 Baum et al.
7,973,218 B2 7/2011 McCutchen et al.
8,090,164 B2 1/2012 Bullitt et al.
8,143,480 B2 3/2012 Axtell et al.
8,548,778 B1 10/2013 Hart et al.
8,554,490 B2 10/2013 Tang et al.
2001/0042257 A1 11/2001 Connor-Ward et al.
2002/0114784 A1 8/2002 Li et al.
2003/0150017 A1 8/2003 Mesa et al.
2003/0154508 A1 8/2003 Stevens et al.
2003/0167537 A1 9/2003 Jiang
2004/0053289 A1 3/2004 Christian et al.
2004/0055041 A1 3/2004 Labate et al.
2004/0072692 A1 4/2004 Hoffmann et al.
2004/0082475 A1 4/2004 Hoffman et al.
2004/0123347 A1 6/2004 Hinchey et al.
2004/0126845 A1 7/2004 Eenennaam et al.
2004/0133944 A1 7/2004 Hake et al.
2004/0147475 A1 7/2004 Li et al.
2004/0177399 A1 9/2004 Hammer et al.
2004/0216189 A1 10/2004 Houmard et al.
2004/0244075 A1 12/2004 Cai et al.
2005/0005319 A1 1/2005 della-Cioppa et al.
2005/0215435 A1 9/2005 Menges et al.
2006/0009358 A1 1/2006 Kibler et al.
2006/0021087 A1 1/2006 Baum et al.
2006/0111241 A1 5/2006 Gerwick, III et al.
2006/0130172 A1 6/2006 Whaley et al.
2006/0135758 A1 6/2006 Wu
2006/0200878 A1 9/2006 Lutfiyya et al.
2006/0223708 A1 10/2006 Hoffmann et al.
2006/0223709 A1 10/2006 Helmke et al.
2006/0247197 A1 11/2006 Van De Craen et al.
2006/0272049 A1 11/2006 Waterhouse et al.
2006/0276339 A1 12/2006 Windsor et al.
2007/0011775 A1 1/2007 Allen et al.
2007/0050863 A1 3/2007 Tranel et al.
2007/0124836 A1 5/2007 Baum et al.
2007/0199095 A1 8/2007 Allen et al.
2007/0250947 A1 10/2007 Boukharov et al.
2007/0259785 A1 11/2007 Heck et al.
2007/0281900 A1 12/2007 Cui et al.
2007/0300329 A1 12/2007 Allen et al.
2008/0022423 A1 1/2008 Roberts et al.
2008/0050342 A1 2/2008 Fire et al.
2008/0092256 A1 4/2008 Kohn
2008/0155716 A1 6/2008 Sonnewald et al.
2008/0214443 A1 9/2008 Baum et al.
2009/0011934 A1 1/2009 Zawierucha et al.
2009/0018016 A1 1/2009 Duck et al.
2009/0036311 A1 2/2009 Witschel et al.
2009/0054240 A1 2/2009 Witschel et al.
2009/0098614 A1 4/2009 Zamore et al.
2009/0118214 A1 5/2009 Paldi et al.
2009/0137395 A1 5/2009 Chicoine et al.
2009/0165153 A1 6/2009 Wang et al.
2009/0165166 A1 6/2009 Feng et al.
2009/0205079 A1 8/2009 Kumar et al.
2009/0215628 A1 8/2009 Witschel et al.
2009/0293148 A1 11/2009 Ren et al.
2009/0298787 A1 12/2009 Raemaekers et al.
2009/0307803 A1 12/2009 Baum et al.
2010/0005551 A1 1/2010 Roberts et al.
2010/0068172 A1 3/2010 Van De Craen
2010/0071088 A1 3/2010 Sela et al.
2010/0099561 A1 4/2010 Selby et al.
2010/0100988 A1* 4/2010 Tranel ................ C12N 15/8274
800/300
2010/0152443 A1 6/2010 Hirai et al.
2010/0154083 A1 6/2010 Ross et al.
2010/0247578 A1 9/2010 Salama
2011/0015084 A1 1/2011 Christian et al.
2011/0015284 A1 1/2011 Dees et al.
2011/0028412 A1 2/2011 Cappello et al.
2011/0035836 A1* 2/2011 Eudes et al. .................. 800/278
2011/0053226 A1 3/2011 Rohayem
2011/0098180 A1 4/2011 Michel et al.
2011/0105327 A1 5/2011 Nelson
2011/0105329 A1 5/2011 Song et al.
2011/0112570 A1 5/2011 Mannava et al.
2011/0126310 A1 5/2011 Feng et al.
2011/0126311 A1 5/2011 Velcheva et al.
2011/0152339 A1 6/2011 Brown et al.
2011/0152346 A1 6/2011 Karleson et al.
2011/0152353 A1 6/2011 Koizumi
2011/0160082 A1 6/2011 Woo et al.
2011/0166022 A1 7/2011 Israels et al.
2011/0166023 A1 7/2011 Nettleton-Hammond et al.
2011/0171176 A1 7/2011 Baas et al.
2011/0171287 A1 7/2011 Saarma et al.
2011/0177949 A1 7/2011 Krapp et al.

(56) References Cited

U.S. PATENT DOCUMENTS

| | | | |
|---|---|---|---|
| 2011/0185444 | A1 | 7/2011 | Li et al. |
| 2011/0185445 | A1 | 7/2011 | Bogner et al. |
| 2011/0191897 | A1 | 8/2011 | Poree et al. |
| 2011/0201501 | A1 | 8/2011 | Song et al. |
| 2011/0296555 | A1 | 12/2011 | Ivashuta et al. |
| 2011/0296556 | A1 | 12/2011 | Sammons et al. |
| 2012/0036594 | A1 | 2/2012 | Cardoza et al. |
| 2012/0107355 | A1 | 5/2012 | Harris et al. |
| 2012/0108497 | A1 | 5/2012 | Paldi et al. |
| 2012/0137387 | A1 | 5/2012 | Baum et al. |
| 2012/0150048 | A1 | 6/2012 | Kang et al. |
| 2012/0156784 | A1 | 6/2012 | Adams, Jr. et al. |
| 2012/0164205 | A1 | 6/2012 | Baum et al. |
| 2012/0185967 | A1 | 7/2012 | Sela et al. |
| 2012/0230565 | A1 | 9/2012 | Steinberg et al. |
| 2012/0258646 | A1 | 10/2012 | Sela et al. |
| 2013/0041004 | A1 | 2/2013 | Drager et al. |
| 2013/0047297 | A1 | 2/2013 | Sammons et al. |
| 2013/0060133 | A1 | 3/2013 | Kassab et al. |
| 2013/0067618 | A1 | 3/2013 | Ader et al. |
| 2013/0084243 | A1 | 4/2013 | Goetsch et al. |
| 2013/0096073 | A1 | 4/2013 | Sidelman |
| 2013/0097726 | A1 | 4/2013 | Ader et al. |
| 2013/0212739 | A1 | 8/2013 | Giritch et al. |
| 2013/0226003 | A1 | 8/2013 | Edic et al. |
| 2013/0247247 | A1 | 9/2013 | Ader et al. |
| 2013/0254940 | A1 | 9/2013 | Ader et al. |
| 2013/0288895 | A1 | 10/2013 | Ader et al. |
| 2013/0318657 | A1 | 11/2013 | Avniel et al. |
| 2013/0318658 | A1 | 11/2013 | Ader et al. |
| 2013/0324842 | A1 | 12/2013 | Mittal et al. |
| 2013/0326731 | A1 | 12/2013 | Ader et al. |
| 2014/0018241 | A1 | 1/2014 | Sammons et al. |
| 2014/0057789 | A1 | 2/2014 | Sammons et al. |
| 2014/0109258 | A1 | 4/2014 | Van De Craen et al. |
| 2014/0230090 | A1 | 8/2014 | Avniel et al. |
| 2014/0274712 | A1 | 9/2014 | Finnessy et al. |
| 2014/0296503 | A1 | 10/2014 | Avniel et al. |

FOREIGN PATENT DOCUMENTS

| | | | | |
|---|---|---|---|---|
| CN | 101914540 | A | * 12/2010 | ............... A01H 5/00 |
| DE | 10000600 | A1 | 7/2001 | |
| DE | 10116399 | A1 | 10/2002 | |
| DE | 10256353 | A1 | 6/2003 | |
| DE | 10256354 | A1 | 6/2003 | |
| DE | 10256367 | A1 | 6/2003 | |
| DE | 10204951 | A1 | 8/2003 | |
| DE | 10234875 | A1 | 2/2004 | |
| DE | 10234876 | A1 | 2/2004 | |
| DE | 102004054666 | A1 | 5/2006 | |
| DE | 102005014638 | A1 | 10/2006 | |
| DE | 102005014906 | A1 | 10/2006 | |
| DE | 102007012168 | A1 | 9/2008 | |
| DE | 102010042866 | A1 | 5/2011 | |
| EP | 0 804 600 | A1 | 11/1997 | |
| EP | 1 157 991 | A2 | 11/2001 | |
| EP | 1 238 586 | A1 | 9/2002 | |
| EP | 1 416 049 | A1 | 5/2004 | |
| EP | 2 147 919 | A1 | 1/2010 | |
| EP | 2 160 098 | B1 | 11/2010 | |
| EP | 2 530 159 | A1 | 3/2011 | |
| EP | 2 305 813 | A2 | 4/2011 | |
| EP | 2 545 182 | A1 | 1/2013 | |
| JP | 2001253874 | A | 9/2001 | |
| JP | 2002080454 | A | 3/2002 | |
| JP | 2002138075 | A | 5/2002 | |
| JP | 2002145707 | A | 5/2002 | |
| JP | 2002220389 | A | 8/2002 | |
| JP | 2003064059 | A | 3/2003 | |
| JP | 2003096059 | A | 4/2003 | |
| JP | 2004051628 | A | 2/2004 | |
| JP | 2004107228 | A | 4/2004 | |
| JP | 2005008583 | A | 1/2005 | |
| JP | 2005239675 | A | 9/2005 | |
| JP | 2005314407 | A | 11/2005 | |
| JP | 2006232824 | A | 9/2006 | |
| JP | 2006282552 | A | 10/2006 | |
| JP | 2007153847 | A | 6/2007 | |
| JP | 2007161701 | A | 6/2007 | |
| JP | 2007182404 | A | 7/2007 | |
| JP | 2008074840 | A | 4/2008 | |
| JP | 2008074841 | A | 4/2008 | |
| JP | 2008133207 | A | 6/2008 | |
| JP | 2008133218 | A | 6/2008 | |
| JP | 2008169121 | A | 7/2008 | |
| JP | 2009067739 | A | 4/2009 | |
| JP | 2009114128 | A | 5/2009 | |
| JP | 2009126792 | A | 6/2009 | |
| JP | 2009137851 | A | 6/2009 | |
| WO | WO 89/11789 | A1 | 12/1989 | |
| WO | WO 95/34659 | A1 | 12/1995 | |
| WO | WO 95/34668 | A2 | 12/1995 | |
| WO | WO 96/05721 | A1 | 2/1996 | |
| WO | WO 96/33270 | A1 | 10/1996 | |
| WO | WO 96/38567 | A2 | 12/1996 | |
| WO | WO 96/40964 | A2 | 12/1996 | |
| WO | WO 99/24585 | A1 | 5/1999 | |
| WO | WO 99/26467 | A1 | 6/1999 | |
| WO | WO 99/27116 | A2 | 6/1999 | |
| WO | WO 99/32619 | A1 | 7/1999 | |
| WO | WO 99/61631 | A1 | 12/1999 | |
| WO | WO 99/67367 | A1 | 12/1999 | |
| WO | WO 00/32757 | A2 | 6/2000 | |
| WO | WO 00/44914 | A1 | 8/2000 | |
| WO | WO 02/14472 | A2 | 2/2002 | |
| WO | WO 02/066660 | A2 | 8/2002 | |
| WO | WO 03/000679 | A2 | 1/2003 | |
| WO | WO 03/006422 | A1 | 1/2003 | |
| WO | WO 03/013247 | A1 | 2/2003 | |
| WO | WO 03/016308 | A1 | 2/2003 | |
| WO | WO 03/020704 | A1 | 3/2003 | |
| WO | WO 03/022051 | A1 | 3/2003 | |
| WO | WO 03/022831 | A1 | 3/2003 | |
| WO | WO 03/022843 | A1 | 3/2003 | |
| WO | WO 03/029243 | A2 | 4/2003 | |
| WO | WO 03/037085 | A1 | 5/2003 | |
| WO | WO 03/037878 | A1 | 5/2003 | |
| WO | WO 03/045878 | A2 | 6/2003 | |
| WO | WO 03/050087 | A2 | 6/2003 | |
| WO | WO 03/051823 | A1 | 6/2003 | |
| WO | WO 03/051824 | A1 | 6/2003 | |
| WO | WO 03/051846 | A2 | 6/2003 | |
| WO | WO 03/076409 | A1 | 9/2003 | |
| WO | WO 03/077648 | A2 | 9/2003 | |
| WO | WO 03/087067 | A1 | 10/2003 | |
| WO | WO 03/090539 | A1 | 11/2003 | |
| WO | WO 03/091217 | A1 | 11/2003 | |
| WO | WO 03/093269 | A2 | 11/2003 | |
| WO | WO 03/104206 | A2 | 12/2003 | |
| WO | WO 2004/002947 | A1 | 1/2004 | |
| WO | WO 2004/002981 | A2 | 1/2004 | |
| WO | WO 2004/005485 | A2 | 1/2004 | |
| WO | WO 2004/009761 | A2 | 1/2004 | |
| WO | WO 2004/011429 | A1 | 2/2004 | |
| WO | WO 2004/022771 | A2 | 3/2004 | |
| WO | WO 2004/029060 | A1 | 4/2004 | |
| WO | WO 2004/035545 | A2 | 4/2004 | |
| WO | WO 2004/035563 | A1 | 4/2004 | |
| WO | WO 2004/035564 | A1 | 4/2004 | |
| WO | WO 2004/037787 | A1 | 5/2004 | |
| WO | WO 2004/049806 | A1 | 6/2004 | |
| WO | WO 2004/062351 | A2 | 7/2004 | |
| WO | WO 2004/067518 | A1 | 8/2004 | |
| WO | WO 2004/067527 | A1 | 8/2004 | |
| WO | WO 2004/074443 | A2 | 9/2004 | |
| WO | WO 2004/077950 | A1 | 9/2004 | |
| WO | WO 2005/000824 | A1 | 1/2005 | |
| WO | WO 2005/003362 | A2 | 1/2005 | |
| WO | WO 2005/007627 | A1 | 1/2005 | |
| WO | WO 2005/040152 | A1 | 5/2005 | |
| WO | WO 2005/047233 | A1 | 5/2005 | |
| WO | WO 2005/047281 | A1 | 5/2005 | |

(56) References Cited

FOREIGN PATENT DOCUMENTS

| | | | |
|---|---|---|---|
| WO | WO 2005/061443 | A2 | 7/2005 |
| WO | WO 2005/061464 | A1 | 7/2005 |
| WO | WO 2005/068434 | A1 | 7/2005 |
| WO | WO 2005/070889 | A1 | 8/2005 |
| WO | WO 2005/089551 | A1 | 9/2005 |
| WO | WO 2005/095335 | A1 | 10/2005 |
| WO | WO 2005/107437 | A2 | 11/2005 |
| WO | WO 2005/110068 | A2 | 11/2005 |
| WO | WO 2006/006569 | A1 | 1/2006 |
| WO | WO 2006/024820 | A1 | 3/2006 |
| WO | WO 2006/029828 | A1 | 3/2006 |
| WO | WO 2006/029829 | A1 | 3/2006 |
| WO | WO 2006/037945 | A1 | 4/2006 |
| WO | WO 2006/050803 | A1 | 5/2006 |
| WO | WO 2006/074400 | A2 | 7/2006 |
| WO | WO 2006/090792 | A1 | 8/2006 |
| WO | WO 2006/123088 | A2 | 11/2006 |
| WO | WO 2006/125687 | A1 | 11/2006 |
| WO | WO 2006/125688 | A1 | 11/2006 |
| WO | WO 2006/138638 | A1 | 12/2006 |
| WO | WO 2007/003294 | A1 | 1/2007 |
| WO | WO 2007/007316 | A1 | 1/2007 |
| WO | WO 2007/024783 | | 3/2007 |
| WO | WO 2007/026834 | A1 | 3/2007 |
| WO | WO 2007/035650 | A2 | 3/2007 |
| WO | WO 2007/039454 | A1 | 4/2007 |
| WO | WO 2007/070389 | A2 | 6/2007 |
| WO | WO 2007/071900 | A1 | 6/2007 |
| WO | WO 2007/074405 | A2 | 7/2007 |
| WO | WO 2007/077201 | A1 | 7/2007 |
| WO | WO 2007/077247 | A1 | 7/2007 |
| WO | WO 2007/080126 | A2 | 7/2007 |
| WO | WO 2007/080127 | A2 | 7/2007 |
| WO | WO 2007/096576 | A1 | 8/2007 |
| WO | WO 2007/051462 | A2 | 10/2007 |
| WO | WO 2007/119434 | A1 | 10/2007 |
| WO | WO 2007/134984 | A1 | 11/2007 |
| WO | WO 2008/007100 | A2 | 1/2008 |
| WO | WO 2008/009908 | A1 | 1/2008 |
| WO | WO 2008/029084 | A1 | 3/2008 |
| WO | WO 2008/042231 | A2 | 4/2008 |
| WO | WO 2008/059948 | A1 | 5/2008 |
| WO | WO 2008/063203 | A2 | 5/2008 |
| WO | WO 2008/071918 | A1 | 6/2008 |
| WO | WO 2008/074991 | A1 | 6/2008 |
| WO | WO 2008/084073 | A1 | 7/2008 |
| WO | WO 2008/100426 | A2 | 8/2008 |
| WO | WO 2008/102908 | A1 | 8/2008 |
| WO | WO 2008/148223 | A1 | 12/2008 |
| WO | WO 2008/152072 | A2 | 12/2008 |
| WO | WO 2008/152073 | A2 | 12/2008 |
| WO | WO 2009/000757 | A1 | 12/2008 |
| WO | WO 2009/005297 | A2 | 1/2009 |
| WO | WO 2009/035150 | A2 | 3/2009 |
| WO | WO 2009/046384 | A1 | 4/2009 |
| WO | WO 2009/063180 | A1 | 5/2009 |
| WO | WO 2009/068170 | A2 | 6/2009 |
| WO | WO 2009/068171 | A2 | 6/2009 |
| WO | WO 2009/086041 | A1 | 7/2009 |
| WO | WO 2009/090401 | A2 | 7/2009 |
| WO | WO 2009/090402 | A2 | 7/2009 |
| WO | WO 2009/115788 | A1 | 9/2009 |
| WO | WO 2009/116558 | A1 | 9/2009 |
| WO | WO 2009/125401 | A2 | 10/2009 |
| WO | WO 2009/152995 | A1 | 12/2009 |
| WO | WO 2009/158258 | A1 | 12/2009 |
| WO | WO 2010/012649 | A1 | 2/2010 |
| WO | WO 2010/026989 | A1 | 3/2010 |
| WO | WO 2010/034153 | A1 | 4/2010 |
| WO | WO 2010/049270 | A1 | 5/2010 |
| WO | WO 2010/049369 | A1 | 5/2010 |
| WO | WO 2010/049405 | A1 | 5/2010 |
| WO | WO 2010/049414 | A1 | 5/2010 |
| WO | WO 2010/063422 | A1 | 6/2010 |
| WO | WO 2010/069802 | A1 | 6/2010 |
| WO | WO 2010/078906 | A2 | 7/2010 |
| WO | WO 2010/078912 | A1 | 7/2010 |
| WO | WO 2010/104217 | A1 | 9/2010 |
| WO | WO 2010/108611 | A1 | 9/2010 |
| WO | WO 2010/112826 | A2 | 10/2010 |
| WO | WO 2010/116122 | A2 | 10/2010 |
| WO | WO 2010/119906 | A1 | 10/2010 |
| WO | WO 2010/130970 | A1 | 11/2010 |
| WO | WO 2011/001434 | A1 | 1/2011 |
| WO | WO 2011/003776 | A2 | 1/2011 |
| WO | WO 2011/035874 | A1 | 3/2011 |
| WO | WO 2011/045796 | A1 | 4/2011 |
| WO | WO 2011/065451 | A1 | 6/2011 |
| WO | WO 2011/067745 | A2 | 6/2011 |
| WO | WO 2011/080674 | A2 | 7/2011 |
| WO | WO 2011/112570 | A1 | 9/2011 |
| WO | WO 2011/132127 | A1 | 10/2011 |
| WO | WO 2012/001626 | A1 | 1/2012 |
| WO | WO 2012/056401 | A1 | 5/2012 |
| WO | WO 2012/092580 | A2 | 7/2012 |
| WO | WO 2013/010691 | A1 | 1/2013 |
| WO | WO 2013/025670 | A1 | 2/2013 |
| WO | WO 2013/039990 | A1 | 3/2013 |
| WO | WO 2013/040005 | A1 | 3/2013 |
| WO | WO 2013/040021 | A1 | 3/2013 |
| WO | WO 2013/040033 | A1 | 3/2013 |
| WO | WO 2013/040049 | A1 | 3/2013 |
| WO | WO 2013/040057 | A1 | 3/2013 |
| WO | WO 2013/040117 | A9 | 3/2013 |
| WO | WO 2013/153553 | A2 | 10/2013 |
| WO | WO 2013/175480 | A1 | 11/2013 |
| WO | WO 2014/106837 | A2 | 7/2014 |
| WO | WO 2014/106838 | A2 | 7/2014 |
| WO | WO 2014/151255 | A1 | 9/2014 |
| WO | WO 2014/164761 | A1 | 10/2014 |
| WO | WO 2014/164797 | A1 | 10/2014 |
| WO | WO 2015/010026 | A2 | 1/2015 |

OTHER PUBLICATIONS

Jofre-Garfias, A. E., et al. "Agrobacterium-mediated transformation of *Amaranthus hypochondriacus*: light- and tissue-specific expression of a pea chlorophyll a/b-binding protein promoter." Plant Cell Reports 16.12 (1997): 847-852.*

Pratt, Donald B., and Lynn G. Clark. "*Amaranthus rudis* and *A. tuberculatus*, One Species or Two'?." Journal of the Torrey Botanical Society (2001): 282-296.*

Street, C., Why is DNA (and not RNA) a stable storage form for genetic information, published online on Jan. 24, 2008, http://biochemistryrevisited.blogspot.com/2008/01/why-is-dna-and-not-rna-stable-storage.html#!/2008/01/why-is-dna-and-not-rna-stable-storage.html.*

Molina, Antonio, et al. "Inhibition of protoporphyrinogen oxidase expression in *Arabidopsis* causes a lesion-mimic phenotype that induces systemic acquired resistance." The Plant Journal 17.6 (1999): 667-678.*

Pratt, Donald B., and Lynn G. Clark. "*Amaranthus rudis* and *A. tuberculatus*, One Species or Two?." Journal of the Torrey Botanical Society (2001): 282-296.*

Tank Mixing Chemicals Applied to Peanut Crops, published online on Jul. 31, 2004 at www.peanut.ncsu.edu/pdffiles/004993/tank_mixing_chemicals_applied_to_peanut_crops.pdf.*

Alarcón-Reverte et al., "Resistance to ACCase-inhibiting herbicides in the weed *Lolium multiflorum," Comm. Appl. Biol. Sci.*, 73(4):899-902 (2008).

Amarzguioui et al., "An algorithm for selection of functional siRNA sequences," *Biochemical and Biophysical Research Communications*, 316:1050-1058 (2004).

Ambrus et al., "The Diverse Roles of RNA Helicases in RNAi," *Cell Cycle*, 8(21):3500-3505 (2009).

An et al., "Transient RNAi Induction against Endogenous Genes in *Arabidopsis* Protoplasts Using in Vitro-Prepared Double-Stranded RNA," *Biosci Biotechnol Biochem*, 69(2):415-418 (2005).

Andersson et al., "A novel selection system for potato transformation using a mutated AHAS gene," *Plant Cell Reports*, 22(4):261-267 (2003).

(56) References Cited

OTHER PUBLICATIONS

Anonymous, "A handbook for high-level expression and purification of 6xHis-tagged proteins," *The QUIexpressionist*, (2003).
Anonymous, "Agronomy Facts 37: Adjuvants for enhancing herbicide performance," *n.p.*, 1-8, (Jan. 26, 2000), *Web*, (Jan. 21, 2014).
Anonymous, "Devgen, The mini-Monsanto," KBC Securities (2006).
Anonymous, "Do Monsanto have the next big thing?," *Austalian Herbicide Resistance Initiative* (*AHRI*), (Apr. 23, 2013) *Web.* (Jan. 19, 2015).
Aoki et al., "In Vivo Transfer Efficiency of Antisense Oligonucleotides into the Myocardium Using HVJ-Liposome Method," *Biochem Biophys Res Commun*, 231:540-545 (1997).
Arpaia et al., "Production of transgenic eggplant (*Solanum melongena* L.) resistant to Colorado Potato Beetle (*Leptinotarsa decemlineata* Say)," (1997) *Theor. Appl. Genet*., 95:329-334 (1997).
Artmymovich, "Using RNA interference to increase crop yield and decrease pest damage," *MMG 445 Basic Biotech*., 5(1):7-12 (2009).
Australian Patent Examination report No. 1 issued Nov. 11, 2013, in Australian Application No. 2011224570.
Axtell et al., "A Two-Hit Trigger for siRNA Biogenesis in Plants," *Cell*, 127:565-577 (2006).
Baerson et al., "Glyphosate-Resistant Goosegrass. Identification of a Mutation in the Target Enzyme 5-Enolpyruvylshikimate-3-Phosphate Synthase," *Plant Physiol*., 129(3):1265-1275 (2002).
Bannerjee et al., "Efficient production of transgenic potato (*S. tuberosum* L. ssp. *andigena*) plants via *Agrobacterium tumefaciens*-mediated transformation," *Plant Sci*., 170:732 738 (2006).
Baulcombe, "RNA silencing and heritable epigenetic effects in tomato and *Arabidopsis*," Abstract 13$^{th}$ Annual Fall Symposium, Plant Genomes to Phenomes, Donald Danforth Plant Science Center, 28-30 (2011).
Bayer et al., "Programmable ligand-controlled riboregulators of eukaryotic gene expression," *Nature Biotechnol*., 23(3):337-343 (2005).
Beal, et al., "Second Structural Motif for Recognition of DNA by Oligonucleotide-Directed Triple-Helix Formation," *Science*, 251:1360-1363 (1992).
Becker et al., "Fertile transgenic wheat from microprojectile bombardment of scutellar tissue," *The Plant Journal*, 5(2):299-307 (1994).
Bhargava et al., "Long double-stranded RNA-mediated RNA interference as a tool to achieve site-specific silencing of hypothalamic neuropeptides," *Brain Research Protocols*, 13:115-125 (2004).
Boletta et al., "High Efficient Non-Viral Gene Delivery to the Rat Kidney by Novel Polycationic Vectors," *J. Am Soc. Nephrol*., 7:1728 (1996).
Bolognesi et al., "Characterizing the Mechanism of Action of Double-Stranded RNA Activity against Western Corn Rootworm(*Diabrotica virgifera virgifera* LeConte)," PLoS One 7(10):e47534 (2012).
Bolter et al., "A chloroplastic inner envelope membrane protease is essential for plant development," *FEBS Letters*, 580:789-794 (2006).
Breaker et al., "A DNA enzyme with $Mg2^{+}$-dependent RNA phosphoesterase activity," *Chemistry and Biology*, 2:655-660 (1995).
Brodersen et al., "The diversity of RNA silencing pathways in plants," *Trends in Genetics*, 22(5):268-280 (2006).
Busi et al., "Gene flow increases the initial frequency of herbicide resistance alleles in unselectedpopulations," *Agriculture, Ecosystems and Environments*, Elsevier, Amsterdam, NL, 142(3):403-409 (2011).
Butler et al., "Priming and re-drying improve the survival of mature seeds of *Digitalis purpurea* during storage," *Annals of Botany*, 103:1261-1270 (2009).
Bytebier et al., "T-DNA organization in tumor cultures and transgenic plants of the monocotyledon *Asparagus officinalis," Proc. Natl. Acad. Sci. U.S.A*., 84:5345-5349 (1987).
Chabbouh et al., "Cucumber mosaic virus in artichoke," *FAO Plant Protection Bulletin*, 38:52-53 (1990).
Chakravarty et al., "Genetic Transformation in Potato: Approaches and Strategies," *Amer J Potato Res*, 84:301 311 (2007).
Chee et al., "Transformation of Soybean (*Glycine max*) by Infecting Germinating Seeds with *Agrobacterium tumefaciens," Plant Physiol*., 91:1212-1218 (1989).
Chen et al., "In Vivo Analysis of the Role of atTic20 in Protein Import into Chloroplasts," *The Plant Cell*, 14:641-654 (2002).
Cheng et al., "Production of fertile transgenic peanut (*Arachis hypogaea* L.) plants using *Agrobacterium tumefaciens," Plant Cell Reports*, 15:653-657 (1996).
Chi et al., "The Function of RH22, a DEAD RNA Helicase, in the Biogenesis of the 50S Ribosomal Subunits of *Arabidopsis* Chloroplasts," *Plant Physiology*, 158:693-707 (2012).
Chinese Office Action issued Aug. 28, 2013 in Chinese Application No. 201180012795.2.
Clough et al., "Floral dip: a simplified method for Agrobacterium-mediated transformation of *Arabidopsis thaliana," The Plant Journal*, 16(6):735-743 (1998).
CN101914540 Patent Diclosure, "Introduction of RNA into plant by interference," (2010).
Colbourne et al., "The Ecoresponsive Genome of *Daphnia pulex," Science*, 331(6017):555-561 (2011).
Colombian Office Action issued Aug. 2, 2013 in Application No. 12 152898.
Colombian Office Action issued Feb. 21, 2014 in Application No. 12 152898.
Cooney et al., "Site-Specific Oligonucleotide Binding Represses Transcription of the Human c-myc Gene in Vitro," *Science* ,241:456-459 (1988).
COST Action FA0806 progress report "Plant virus control employing RNA-based vaccines: A novel non-transgenic strategy" (2010).
Coticchia et al., "Calmodulin modulates Akt activity in human breast cancer cell lines," *Breast Cancer Res. Treat*, 115:545-560 (2009).
Dalmay et al., "An RNA-Depenedent RNA Polymerase Gene in *Arabidopsis* is Required for Posttranscriptional Gene Silencing Mediated by a Transgene but Not by a Virus," *Cell*, 101:543-553 (2000).
Database EMBL CBIB Daphnia—XP-002732239 (2011).
Davidson et al., "Engineering regulatory RNAs," *TRENDS in Biotechnology*, 23(3):109-112 (2005).
De Block, et al. "Engineering herbicide resistance in plants by expression of a detoxifying enzyme," *EMBO J.* 6(9):2513-2519 (1987).
De Framond, "MINI-Ti: A New Vector Strategy for Plant Genetic Engineering," *Nature Biotechnology*, 1:262-269 (1983).
della-Cioppa et al., "Import of a precursor protein into chloroplasts is inhibited by the herbicide glyphosate," *The EMBO Journal*, 7(5):1299-1305 (1988).
Diallo et al., "Long Endogenous dsRNAs Can Induce Complete Gene Silencing in Mammalian Cells and Primary Cultures," *Oligonucleotides*, 13:381-392 (2003).
Dietemann et al., "*Varroa destructor*: research avenues towards sustainable control," *Journal of Apicultural Research*, 51(1):125-132 (2012).
Du et al., "A systematic analysis of the silencing effects of an active siRNA at all single-nucleotide mismatched target sites," *Nucleic Acids Research*, 33(5):1671-1677 (2005).
Dunoyer et al., "Small RNA Duplexes Function as Mobile Silencing Signals Between Plant Cells," *Science*, 328:912-916 (2010).
Ellington et al., "In vitro selection of RNA molecules that bind specific ligands," *Nature*, 346:818-822 (1990).
Eurasian Office Action issued Feb. 24, 2014, in Application No. 201201264.
European Cooperation in the field of Scientific and Technical Research—Memorandum of Understanding for COST Action FA0806 (2008).
European Supplemental Search Report issued Oct. 8, 2013 in Application No. 11753916.3.
Extended European Search Report dated Jan. 21, 2015, in European Patent Application No. 12 832 415.9.
Extended European Search Report dated Jan. 29, 2015, in European Patent Application No. 12 831 567.8.

(56) References Cited

OTHER PUBLICATIONS

Extended European Search Report dated Feb. 2, 2015, in European Patent Application No. 12 830 932.5.
Extended European Search Report dated Feb. 3, 2015, in European Patent Application No. 12 831 945.6.
Extended European Search Report dated Feb. 27, 2015, in European Patent Application No. 12 832 160.1.
Extended European Search Report dated Mar. 3, 2015, in European Patent Application No. 12 831 166.9.
Extended European Search Report dated Mar. 17, 2015, in European Patent Application No. 12 831 684.1.
Partial Supplementary European Search Report dated Mar. 2, 2015, in European Patent Application No. 12 831 494.5.
Farooq et al., "Rice seed priming," *IPRN*, 30(2):45-48 (2005).
Fire et al., "Potent and specific genetic interference by double-stranded RNA in *Caenorhabditis elegans,*" *Nature*, 391:806-811 (1998).
First Examination Report issued on Apr. 23, 2013, in New Zealand Patent Application No. 601784.
First Examination Report issued on Jul. 28, 2014, in New Zealand Patent Application No. 627060.
Fukuhara et al., "Enigmatic Double-Stranded RNA in Japonica Rice," *Plant Molecular Biology*, 21:1121-1130 (1993).
Fukuhara et al., "The Unusual Structure of a Novel RNA Replicon in Rice," *The Journal of Biological Chemistry*, 270(30):18147-18149 (1995).
Fukuhara et al., "The wide distribution of endornaviruses, large double-stranded RNA replicons with plasmid-like properties," *Archives of Virology*, 151:995-1002 (2006).
Further Examination Report issued in New Zealand Patent Application No. 601784 on May 16, 2014.
Gaines et al., "Gene amplification confers glyphosate resistance in *Amaranthus palmeri,*" *Proc. Natl. Acad. Sci. USA*, 107(3):1029-1034 (2010).
Gallie et al., "Identification of the motifs within the tobacco mosaic virus 5'-leader responsible for enhancing translation," *Nucleic Acids Res.*, 20(17):4631-4638 (1992).
Gan et al., "Bacterially expressed dsRNA protects maize against SCMV infection," *Plant Cell Rep*, 11:1261-1268 (2010).
Gao et al., "Down-regulation of acetolactate synthase compromises 01-1-mediated resistance to powdery mildew in tomato," *BMC Plant Biology*, 14 (2014).
Garbian et al., "Bidirectional Transfer of RNAi between Honey Bee and *Varroa destructor: Varroa* Gene Silencing Reduces *Varroa* Population," 8(12):1-9:e1003035 (2012).
Ge et al., "Rapid vacuolar sequestration: the horseweed glyphosate resistance mechanism," *Pest Management Sci.*, 66:345-348 (2010).
GenBank Accession No. DY640489, PU2_plate27_F03 PU2 Prunus persica cDNA similar to expressed mRNA inferred from Prunus persica hypothetical domain/motif containing IPR011005:Dihydropteroate synthase-like, MRNA sequence (2006) [Retrieved on Feb. 4, 2013]. Retrieved from the internet <URL: http://www.ncbi.nlm.nih.gov/nucest/DY640489>.
GenBank Accession No. EU24568—"*Amaranthus hypochondriacus* acetolactate synthase (ALS) gene," (2007).
GenBank Accession No. FJ972198, Solanum lycopersicum cultivar Ailsa Craig dihydropterin pyrophosphokinase-dihydropteroate synthase (HPPK-DHPS) gene, complete cds (2010) [Retrieved on Nov. 26, 2012]. Retrieved from the interne ,URL: http://www.ncbi.nlm.nih.gov/nuccore/FJ972198>.
GenBank accession No. AY545657.1, published 2004.
GenBank accession No. GI:186478573, published Jan. 22, 2014.
GenEmbl FJ861243, published Feb. 3, 2010.
Gong et al., "Silencing of Rieske iron—sulfur protein using chemically synthesised siRNA as a potential biopesticide against Plutella xylostella," *Pest Manag Sci*, 67:514-520 (2011).
Gressel et al., "A strategy to provide long-term control of weedy rice while mitigating herbicide resistance transgene flow, and its potential use for other crops with related weeds," *Pest Manag Sci*, 65(7):723-731 (2009).
Gutensohn et al., "Functional analysis of the two *Arabidopsis* homologues of Toc34, a component of the chloroplast protein import apparatus," *The Plant Journal*, 23(6):771-783 (2000).
Haigh, "The Priming of Seeds: Investigation into a method of priming large quantities of seeds using salt solutions," Thesis submitted to Macquarie University (1983).
Hamilton et al., "Guidelines for the Identification and Characterization of Plant Viruses," *J. gen. Virol.*, 54:223-241 (1981).
Hamilton et al., "Two classes of short interfering RNA in RNA silencing," *EMBO J.*, 21(17):4671-4679 (2002).
Han et al., "Molecular Basis for the Recognition of Primary microRNAs by the Drosha-DGCR8 Complex," *Cell*, 125(5):887-901 (2006).
Hannon, "RNA interference," *Nature*,481:244-251 (2002).
Hardegree, "Drying and storage effects on germination of primed grass seeds," *Journal of Range Management*, 47(3):196-199 (1994).
Harrison et al., "Does Lowering Glutamine Synthetase Activity in Nodules Modigy Nitrogen Metabolism and Growth of *Lotus japonicus?,*" *Plant Physiology*, 133:253-262 (2003).
Herman et al., "A three-component dicamba O-demethylase from *Pseudomonas maltophilia*, strain DI-6: gene isolation, characterization, and heterologous expression," *J. Biol. Chem.*, 280: 24759-24767 (2005).
Hewezi et al., "Local infiltration of high- and low-molecular-weight RNA from silenced sunflower (*Helianthus annuus* L.) plants triggers post-transcriptional gene silencing in non-silenced plants," *Plant Biotechnology Journal*, 3:81-89 (2005).
Hidayat et al., "Enhanced Metabolism of Fluazifop Acid in a Biotype of *Digitaria sanguinalis* Resistant to the Herbicide Fluazifop-P-Butyl," *Pesticide Biochem. Physiol.*, 57:137-146 (1997).
Himber et al., "Transitivity-dependant and -independent cell-to-cell movement of RNA silencing," *The EMBO Journal*, 22(17):4523-4533 (2003).
Hirschberg et al., "Molecular Basis of Herbicide Resistance in *Amaranthus hybridus,*" *Science*, 222:1346-1349 (1983).
Hoekema et al., "A binary plant vector strategy based on separation of *vir*- and T-region of the *Agrobacterium tumefaciens* Ti-plasmid," *Nature*, 303:179-180 (1983).
Hofgen et al., "Repression of Acetolactate Synthase Activity through Antisense Inhibition: Molecular and Biochemical Analysis of Transgenic Potato (*Solanum tuberosum* L. cv Desiree) Plants," *Plant Physiol.*, 107(2):469-477 (1995).
Hsieh et al., "A library of siRNA duplexes targeting the phosphoinositide 3-kinase pathway: determinants of gene silencing for use in cell-based screens," *Nucleic Acids Res.*, 32(3):893-901 (2004).
Huesken et al., "Design of a genome-wide siRNA library using an artificial neural network," *Nature Biotechnology*, 23(8): 995-1001 (2005).
Hunter et al., "RNA Interference Strategy to suppress Psyllids & Leafhoppers," *International Plant and Animal Genome XIX*, 15-19 (2011).
Ichihara et al., "Thermodynamic instability of siRNA duplex is a prerequisite for dependable prediction of siRNA activities," *Nucleic Acids Res.*, 35(18):e123 (2007).
International Preliminary Report on Patentability issued on Sep. 11, 2014, in International Application No. PCT/IL13/50447.
International Search Report and the Written Opinion dated May 10, 2011, in International Application No. PCT/US 11/27528.
International Search Report and the Written Opinion dated Feb. 25, 2013, in International Application No. PCT/US 12/54883.
International Search Report and the Written Opinion dated Feb. 27, 2013, in International Application No. PCT/US 12/54814.
International Search Report and the Written Opinion dated Feb. 27, 2013, in International Application No. PCT/US 12/54842.
International Search Report and the Written Opinion dated Feb. 27, 2013, in International Application No. PCT/US 12/54862.
International Search Report and the Written Opinion dated Feb. 27, 2013, in International Application No. PCT/US 12/54894.
International Search Report and the Written Opinion dated Feb. 27, 2013, in International Application No. PCT/US 12/54974.
International Search Report and the Written Opinion dated Feb. 27, 2013, in International Application No. PCT/US 12/54980.

(56) References Cited

OTHER PUBLICATIONS

International Search Report and the Written Opinion dated Oct. 1 2013, in International Application No. PCT/IL2013/050447.
International Search Report and the Written Opinion dated Jul. 15 2014, in International Application No. PCT/US2014/025305.
International Search Report and the Written Opinion dated Jul. 22 2014, in International Application No. PCT/IL2013/051083.
International Search Report and the Written Opinion dated Jul. 22 2014, in International Application No. PCT/IL2013/051085.
International Search Report and the Written Opinion dated Jul. 24 2014, in International Application No. PCT/US2014/026036.
International Search Report and Written Opinion dated Aug. 25, 2014, in International Application No. PCT/US2014/023503.
International Search Report and Written Opinion dated Aug. 27, 2014, in International Application No. PCT/US2014/023409.
International Search Report and Written Opinion dated Feb. 23, 2015, in International Application No. PCT/US2014/063832.
International Search Report dated Mar. 12, 2013, in International Application No. PCT/US 12/54789.
Invitation to Pay Additional Fees dated May 6, 2014, in International Application No. PCT/IL2013/051083.
Invitation to Pay Additional Fees dated May 6, 2014, in International Application No. PCT/IL2013/051085.
Invitation to Pay Additional Fees dated Nov. 25, 2014, in International Application No. PCT/US2014/047204.
Isaacs et al., "Engineered riboregulators enable post-transcriptional control of gene expression," *Nature Biotechnology*, 22(7):841-847 (2004).
Ji et al., "Regulation of small RNA stability: methylation and beyond," *Cell Research*, 22:624-636 (2012).
Jones-Rhoades et al., "MicroRNAs and Their Regulatory Roles in Plants," *Annu. Rev. Plant Biol*., 57:19-53 (2006).
Josse et al., "A DELLA in Disguise: SPATULA Restrains the Growth of the Developing *Arabidopsis* Seedling," *Plant Cell*, 23:1337-1351 (2011).
Kam et al., "Nanotube Molecular Transporters: In—Protein Conjugates into Mammalian Cells," *J. Am. Chem. Soc*., 126(22):6850-6851 (2004).
Katoh et al., "Specific residues at every third position of siRNA shape its efficient RNAi activity," *Nucleic Acids Res*., 35(4): e27 (2007).
Kertbundit et al., "In vivo random β-glucuronidase gene fusions in *Arabidopsis thaliana," Proc. Natl. Acad. Sci. U S A*., 88:5212-5216 (1991).
Khachigian, "DNAzymes: Cutting a path to a new class of therapeutics," *Curr Opin Mol Ther* 4(2):119-121 (2002).
Khodakovskaya et al., "Carbon Nanotubes Are Able to Penetrate Plant Seed Coat and Dramatically Affect Seed Germination and Plant Growth," *ACS Nano*, 3(10):3221-3227 (2009).
Kirkwood, "Use and Mode of Action of Adjuvants for Herbicides: A Review of some Current Work," *Pestic Sci*., 38:93-102 (1993).
Klahre et al., "High molecular weight RNAs and small interfering RNAs induce systemic posttranscriptional gene silencing in plants," *Proc. Natl. Acad. Sci. USA*, PNAS, 99(18):11981-11986 (2002).
Kronenwett et al., "Oligodeoxyribonucleotide Uptake in Primary Human Hematopoietic Cells is Enhanced by Cationic Lipids and Depends on the Hematopoietic Cell Subset," *Blood*, 91(3):852-862 (1998).
Kumar et al., "Sequencing, *De Novo* Assembly and Annotation of the Colorado Potato Beetle, *Leptinotarsa decemlineata*,Transcriptome," *PLoS One*, 9(1):e86012 (2014).
Kusaba et al., "*Low glutelin content1*: A Dominant Mutation That Suppresses the *Glutelin* Multigene Family via RNA Silencing ni Rice," *The Plant Cell*, 15(6):1455-1467 (2003).
Kusaba, "RNA interference in crop plants," *Curr Opin Biotechnol*, 15(2):139-143 (2004).
Lavigne et al., "Enhanced antisense inhibition of human immunodeficiency virus type 1 in cell cultures by DLS delivery system," *Biochem Biophys Res Commun*, 237:566-571 (1997).
Lee et al., "Aptamer Database," *Nucleic Acids Research*, 32:D95-D100 (2004).
Lermontova et al., "Reduced activity of plastid protoporphyrinogen oxidase causes attenuated photodynamic damage during high-light compared to low-light exposure," *The Plant Journal*, 48(4):499-510 (2006).
Lesnik et al., "Prediction of rho-independent transcriptional terminators in *Escherichia coli," Nucleic Acids Research*, 29(17):3583-3594 (2001).
Li et al., "Establishment of a highly efficient transformation system for pepper (*Capsicum annuum* L.)," *Plant Cell Reports*, 21: 785-788 (2003).
Li et al., "The FAST technique: a simplified Agrobacterium-based transformation method for transient gene expression analysis in seedlings of *Arabidopsis* and other plant species," *Plant Methods*, 5(6):1-15 (2009).
Liu et al., "Carbon Nanotubes as Molecular Transporters for Walled Plant Cells," *Nano Letters*, 9(3):1007-1010 (2009).
Liu et al., "Comparative study on the interaction of DNA with three different kinds of surfactants and the formation of multilayer films," *Bioelectrochemistry*, 70:301-307 (2007).
Liu et al., "DNAzyme-mediated recovery of small recombinant RNAs from a 5S rRNA-derived chimera expressed in *Escherichia coli," BMC Biotechnology*, 10:85 (2010).
Llave et al., "Endogenous and Silencing-Associated Small RNAs in Plants," *The Plant Cell*, 14:1605-1619 (2002).
Lu et al., "RNA silencing in plants by the expression of siRNA duplexes," *Nucleic Acids Res*., 32(21):e171 (2004).
Lu et al., "Oligo Walk: an online siRNA design tool utilizing hybridization thermodynamics," *Nucleic Acids Research*, 36:W104-W108 (2008).
Luft, "Making sense out of antisense oligodeoxynucleotide delivery: getting there is half the fun," *J Mol Med*, 76:75-76 (1998).
Maas et al., "Mechanism and optimized conditions for PEG mediated DNA transfection into plant protoplasts," *Plant Cell Reports*, 8:148-149 (1989).
Maher III et al. ,"Inhibition of DNA binding proteins by oligonucleotide-directed triple helix formation," *Science*, 245(4919):725-730 (1989).
Makkouk et al., "Virus Diseases of Peas, Beans, and Faba Bean in the Mediterranean region," *Adv Virus Res*, 84:367-402 (2012).
Mandal et al., "Adenine riboswitches and gene activation by disruption of a transcription terminator," *Nature Struct. Mol. Biol*., 11(1):29-35 (2004).
Mandal et al., "Gene Regulation by Riboswitches," *Nature Reviews Molecular Cell Biology*, 5:451-463 (2004).
Manoharan, "Oligonucleotide Conjugates as Potential Antisense Drugs with Improved Uptake, Biodistribution, Targeted Delivery, and Mechanism of Action," *Antisense & Nucleic Acid Drug Development*, 12:103-128 (2002).
Masoud et al., "Constitutive expression of an inducible β-1,3-glucanase in alfalfa reduces disease severity caused by the oomycete pathogen *Phytophthora megasperma* f. sp *medicaginis*, but does not reduce disease severity of chitincontaining fungi," *Transgenic Research*, 5:313-323 (1996).
Matveeva et al., "Prediction of antisense oligonucleotide efficacy by in vitro methods," *Nature Biotechnology*, 16:1374-1375 (1998).
Meinke, et al., "Identifying essential genes in *Arabidopsis thaliana," Trends Plant Sci*., 13(9):483-491 (2008).
Meins et al., "RNA Silencing Systems and Their Relevance to Plant Development," *Annu. Rev. Cell Dev. Biol*., 21:297-318 (2005).
Melnyk et al., "Intercellular and systemic movement of RNA silencing signals," *The EMBO Journal*, 30:3553-3563 (2011).
Misawa et al., "Functional expression of the *Erwinia uredovora* carotenoid biosynthesis gene *crtl* in transgenic plants showing an increase of β-carotene biosynthesis activity and resistance to the bleaching herbicide norflurazon," *The Plant Journal*, 4(5):833-840 (1993).
Misawa et al., "Expression of an *Erwinia* phytoene desaturase gene not only confers multiple resistance to herbicides interfering with carotenoid biosynthesis but also alters xanthophyll metabolism in transgenic plants," *The Plant Journal*, 6(4):481-489 (1994).
Miura et al., "The Balance between Protein Synthesis and Degradation in Chloroplasts Determines Leaf Variegation in *Arabidopsis* yellow variegated Mutants," *The Plant Cell*, 19:1313-1328 (2007).

(56) References Cited

OTHER PUBLICATIONS

Molnar et al., "Plant Virus-Derived Small Interfering RNAs Originate redominantly from Highly Structured Single-Stranded Viral RNAs," *Journal of Virology*, 79(12):7812-7818 (2005).
Molnar et al., "Small Silencing RNAs in Plants Are Mobile and Direct Epigenetic Modification in Recipient Cells," *Science*, 328:872-875 (2010).
Moriyama et al., "Double-stranded RNA in rice: a novel RNA replicon in plants," *Molecular & General Genetics*, 248(3):364-369 (1995).
Moriyama et al., "Stringently and developmentally regulated levels of a cytoplasmic double-stranded RNA and its high-efficiency transmission via egg and pollen in rice," *Plant Molecular Biology*, 31:713-719 (1996).
Morrissey et al., "Potent and persistent in vivo anti-HBV activity of chemically modified siRNAs," *Nat Biotechnol.* 23(8):1002-1007 (2005).
Moser et al., "Sequence-Specific Cleavage of Double Helical DNA by Triple Helix Formation," *Science*, 238:645-646 (1987).
Nowak et al., "A new and efficient method for inhibition of RNA viruses by DNA interference," *The FEBS Journal*, 276:4372-4380 (2009).
Office Action dated Feb. 17, 2014, in Mexican Patent Application No. MX/a/2012/010479.
Office Action issued on Jan. 6, 2015, in Japanese Patent Application No. 2012-557165.
Office Action issued on Nov. 19, 2014, in Eurasian Patent Application No. 201201264/28.
Office Action issued on Nov. 3, 2014, in Chinese Patent Application No. 201180012795.2.
Ongvarrasopone et al., "A Simple and Cost Effective Method to Generate dsRNA for RNAi Studies in Invertebrates," *Science Asia*, 33:35-39 (2007).
Ouellet et al., "Members of the Acetohydroxyacid Synthase Muligene Family of *Brassica napus* Have Divergent Patterns of Expression," *The Plant Journal*, Blackwell Scientific Publications, Oxford, GB, 2(3):321-330 (1992).
Paddison et al., "Stable suppression of gene expression by RNAi in mammalian cells," *Proc. Natl Acad. Sci. USA*, 99(3):1443-1448 (2002).
Palauqui et al., "Activation of systemic acquired silencing by localised introduction of DNA," *Current Biology*, 9:59-66 (1999).
Parera et al., "Dehydration Rate after Solid Matrix Priming Alters Seed Performance of *Shrunken*-2 Corn," *J. Amer. Soc. Hort. Sci.*, 119(3):629-635 (1994).
Paungfoo-Lonhienne et al., "DNA is Taken up by Root Hairs and Pollen, and Stimulates Root and Pollen Tube Growth," *Plant Physiology*, 153:799-805 (2010).
Paungfoo-Lonhienne et al., "DNA uptake by *Arabidopsis* induces changes in the expression of CLE peptides which control root morphology," *Plant Signaling & Behavior*, 5(9):1112-1114 (2010).
Pei et al., "On the art of identifying effective and specific siRNAs," *Nature Methods*, 3(9):670-676 (2006).
Peretz et al., "A Universal Expression/Silencing Vector in Plants," *Plant Physiology*, 145:1251-1263 (2007).
Pornprom et al., "Glutamine synthetase mutation conferring target-site-based resistance to glufosinate in soybean cell selections," *Pest Manag Sci*, 2009; 65(2):216-222 (2009).
Preston et al., "Multiple effects of a naturally occurring proline to threonine substitution within acetolactate synthase in two herbicide-resistant populations of *Lactuca serriola," Pesticide Biochem. Physiol.*, 84(3):227-235 (2006).
Qiwei,"Advance in DNA interference," *Progress in Veterinary Medicine*, 30(1):71-75 (2009).
Rajur et al., "Covalent Protein—Oligonucleotide Conjugates for Efficient Delivery of Antisense Molecules," *Bioconjug Chem.*, 8:935-940 (1997).
Reddy et al "Organosilicone Adjuvants Increased the Efficacy of Glyphosate for Control of Weeds in *Citrus* (*Citrus* spp.)" *HortScience* 27(9):1003-1005 (1992).
Reddy et al., "Aminomethylphosphonic Acid Accumulation in Plant Species Treated with Glyphosate," *J. Agric. Food Chem.*, 56(6):2125-2130 (2008).
Reither et al., "Specificity of DNA triple helix formation analyzed by a FRET assay," *BMC Biochemistry*, 3:27 (2002).
Rey et al., "Diversity of Dicotyledenous-Infecting Geminiviruses and Their Associated DNA Molecules in Southern Africa, Including the South-West Indian Ocean Islands," *Viruses*, 4:1753-1791 (2012).
Reynolds et al., "Rational siRNA design for RNA interference," *Nature Biotechnology*, 22:326-330 (2004).
Ryabov et al., "Cell-to-Cell, but Not Long-Distance, Spread of RNA Silencing That is Induced in Individual Epidermal Cells," *Journal of Virology*, 78(6):3149-3154 (2004).
Ryan, "Human endogenous retroviruses in health and disease: a symbiotic perspective," *Journal of the Royal Society of Medicine*, 97:560-565 (2004).
Santoro et al., "A general purpose RNA-cleaving DNA enzyme," *Proc. Natl. Acad. Sci. USA*, 94:4262-4266 (1997).
Sathasivan et al., "Nucleotide sequence of a mutant acetolactate synthase gene from an imidazolinone-resistant *Arabidopsis thaliana* var. Columbia," *Nucleic Acids Research*, 18(8):2188-2193 (1990).
Schwab et al., "RNA silencing amplification in plants: Size matters," *PNAS*, 107(34):14945-14946 (2010).
Schwember et al., "Drying Rates following Priming Affect Temperature Sensitivity of Germination and Longevity of Lettuce Seeds," *HortScience*, 40(3):778-781 (2005).
Second Chinese Office Action issued in Chinese Patent Application No. 201180012795.2, dated Jun. 10, 2014.
Seidman et al., "The potential for gene repair via triple helix formation," *J Clin Invest.*, 112(4):487-494 (2003).
Selvarani et al., "Evaluation of seed priming methods to improve seed vigour of onion (*Allium cepa* cv. *aggregatum*) and carrot (*Daucus carota*)," *Journal of Agricultural Technology*, 7(3):857-867 (2011).
Sharma et al., "A simple and efficient *Agrobacterium*-mediated procedure for transformation of tomato," *J. Biosci.*, 34(3):423 433 (2009).
Sijen et al., "On the Role of RNA Amplification in dsRNA-Triggered Gene Silencing," *Cell*, 107:465-476 (2001).
Silwet L-77 Spray Adjuvant for agricultural applications, product description from Momentive Performance Materials, Inc. (2003).
Singh et al., "Absorption and translocation of glyphosate with conventional and organosilicone adjuvants," *Weed Biology and Management*, 8:104-111 (2008).
Steeves et al., "Transgenic soybeans expressing siRNAs specific to a major sperm protein gene suppress *Heterodera glycines* reproduction," *Funct. Plant Biol.*, 33:991-999 (2006).
Stock et al., "Possible Mechanisms for Surfactant-Induced Foliar Uptake of Agrochemicals," *Pestic. Sci.*, 38:165-177 (1993).
Strat et al., "Specific and nontoxic silencing in mammalian cells with expressed long dsRNAs," *Nucleic Acids Research*, 34(13):3803-3810 (2006).
Sudarsan et al., "Metabolite-binding RNA domains are present in the genes of eukaryotes," *RNA*, 9:644-647 (2003).
Sun et al., "Antisense oligodeoxynucleotide inhibition as a potent strategy in plant biology: identification of SUSIBA2 as a transcriptional activator in plant sugar signalling," *The Plant Journal*, 44:128-138 (2005).
Sun et al., "A Highly efficient Transformation Protocol for Micro-Tom, a Model Cultivar for Tomato Functional Genomics," *Plant Cell Physiol.*, 47(3):426-431 (2006).
Sun et al., "Sweet delivery—sugar translocators as ports of entry for antisense oligodeoxynucleotides in plant cells," *The Plant Journal*, 52:1192-1198 (2007).
Takasaki et al., "An Effective Method for Selecting siRNA Target Sequences in Mammalian Cells," *Cell Cycle*, 3:790-795 (2004).
Temple et al., "Can glutamine synthetase activity levels be modulated in transgenic plants by the use of recombinant DNA technology?" *Transgenic Plants and Plant Biochemistry*, 22:915-920 (1994).
Temple et al., "Down-regulation of specific members of the glutamine synthetase gene family in Alfalfa by antisense RNA technology," *Plant Molecular Biology*, 37:535-547 (1998).

(56) References Cited

OTHER PUBLICATIONS

Templeton et al., "Improved DNA: liposome complexes for increased systemic delivery and gene expression," *Nature Biotechnology*, 15:647-652 (1997).
Tenllado et al., "Crude extracts of bacterially expressed dsRNA can be used to protect plants against virus infection," *BMC Biotechnology*, 3(3):1-11 (2003).
Tenllado et al., "RNA interference as a new biotechnological tool for the control of virus diseases in plants," *Virus Research*, 102:85-96 (2004).
Tepfer, "Risk assessment of virus resistant transgenic plants," *Annual Review of Phytopathology*, 40:467-491 (2002).
The Seed Biology Place, Website Gerhard Leubner Lab Royal Holloway, University of London, <http://www.seedbiology.de/seedtechnology.asp.
Third Party Submission filed on Nov. 29, 2012 in U.S. Appl. No. 13/042,856.
Thompson, et al., "CLUSTAL W: improving the sensitivity of progressive multiple sequence alignment through sequence weighting, position-specific gap penalties and weight matrix choice," *Nucl. Acids Res.*, 22(22):4673-4680 (1994).
Timmons et al., "Specific interference by ingested dsRNA," *Nature*, 395:854 (1998).
Tomari et al., "Perspective: machines for RNAi," *Genes & Dev.*, 19:517-529 (2005).
Töpfer et al., "Uptake and Transient Expression of Chimeric Genes in Seed-Derived Embryos," *Plant Cell*, 1:133-139 (1989).
Toriyama et al., "Transgenic Rice Plants After Direct Gene Transfer Into Protoplasts," *Bio/Technology*, 6:1072-1074 (1988).
Tran et al., "Control of specific gene expression in mammalian cells by co-expression of long complementary RNAs," *FEBS Lett.*;573(1-3):127-134 (2004).
Turina et al., "Tospoviruses in the Mediterranean Area," *Advances in Virus Research*, 84:403-437 (2012).
Tuschl, "RNA Interference and Small Interfering RNAs," *ChemBiochem*. 2(4):239-245 (2001).
Tuschl, "Expanding small RNA interference," *Nature Biotechnol.*, 20: 446-448 (2002).
Ui-Tei et al., "Guidelines for the selection of highly effective siRNA sequences for mammalian and chick RNA interference," *Nucleic Acids Res.*, 32(3): 936-948 (2004).
Unnamalai et al., "Cationic oligopeptide-mediated delivery of dsRNA for post-transcriptional gene silencing in plant cells," *FEBS Letters*, 566:307-310 (2004).
Unniraman et al., "Alternate Paradigm for Intrinsic Transcription Termination in Eubacteria," *The Journal of Biological Chemistry*, 276(45)(9):41850-41855 (2001).
Urayama et al., "Knock-down of *OsDCL2* in Rice Negatively Affects Maintenance of the Endogenous dsRNA Virus, *Oryza sativa* Endornavirus," *Plant and Cell Physiology*, 51(1):58-67 (2010).
Wardell, "Floral Induction of Vegetative Plants Supplied a Purified Fraction of Deoxyribonucleic Acid from Stems of Flowering Plants," *Plant Physiol*, 60:885-891 (1977).
Wardell,"Floral Activity in Solutions of Deoxyribonucleic Acid Extracted from Tobacco Stems," *Plant Physiol*, 57:855-861 (1976).
Waterhouse et al., "Virus resistance and gene silencing in plants can be induced by simultaneous expression of sense and antisense RNA," *Proc Natl Acad Sci USA*, 95 13959-13964 (1998).
Welch et al., "Expression of ribozymes in gene transfer systems to modulate target RNA levels," *Curr Opin Biotechnol*. 9(5):486-496 (1998).
Wilson, et al., "Transcription termination at intrinsic terminators: The role of the RNA hairpin," *Proc. Natl. Acad. Sci. USA*, 92:8793-8797 (1995).
Winkler et al., "Thiamine derivatives bind messenger RNAs directly to regulate bacterial gene expression," *Nature*, 419:952-956 (2002).
Written Opinion dated May 8, 2014, in International Application No. PCT/IL2013/050447.
Written Opinion dated Sep. 1, 2014, in Singapore Patent Application No. 201206152-9.
Xu et al., Characterization and Functional Analysis of the Calmodulin-Binding Domain of Racl GTPase, *Plos One*, 7(8)1-12:e42975 (2012).
Yin et al., "Production of double-stranded RNA for interference with TMV infection utilizing a bacterial prokaryotic expression system," *Appl. Microbiol. Biotechnol.*, 84(2):323-333 (2009).
van de Wetering et al., "Specific inhibition of gene expression using a stably integrated, inducible small-interfering-RNA vector," *EMBO Rep.*, 4(6):609-615 (2003).
Vasil et al., "Herbicide Resistant Fertile Transgenic Wheat Plants Obtained by Microprojectile Bombardment of Regenerable Embryogenic Callus," *Bio/Technology*,10:667-674 (1992).
Vaucheret, "Post-transcriptional small RNA pathways in plants: mechanisms and regulations," *Genes Dev.*, 20:759-771 (2006).
Vencill et al., "Resistance of Weeds to Herbicides," *Herbicides and Environment*, 29:585-594 (2011).
Verma et al., "Modified oligonucleotides: synthesis and strategy for users," *Annu. Rev. Biochem.*, 67:99-134 (1998).
Vert et al., "An accurate and interpretable model for siRNA efficacy prediction," *BMC Bioinformatics*, 7:520 (2006).
Vionnet et al., "Systemic Spread of Sequence-Specific Transgene RNA Degradation in Plants is Initiated by Localized Introduction of Ectopic Promoterless DNA," *Cell*, 95:177-187 (1998).
Wakelin et al., "A target-site mutation is present in a glyphosate-resistant *Lolium rigidum* population," *Weed Res.* (*Oxford*), 46(5):432-440 (2006).
Walton et al., "Prediction of antisense oligonucleotide binding affinity to a structured RNA target," *Biotechnol Bioeng* 65(1):1-9 (1999).
Wan et al., "Generation of Large Numbers of Independently Transformed Fertile Barley Plants," *Plant Physiol.*, 104:37-48 (1994).
YouTube video by General Electric Company "Silwet Surfactants," screen shot taken on Jan. 11, 2012 of video of www.youtube.com/watch?v=WBw7nXMqHk8 (uploaded Jul. 13, 2009).
Zagnitko, "Lolium regidum clone LS1 acetyl-CoA carboxylase mRNA, partial cds; nuclear gene for plastid product," GenBank: AF359516.1, 2 pages (2001).
Zagnitko, et al., "An isoleucine/leucine residue in the carboxyltransferase domain of acetyl-CoA carboxylase is critical for interaction with aryloxyphenoxypropionate and cyclohexanedione inhibitors," *PNAS*, 98(12):6617-6622 (2001).
Zhang et al., "A novel rice gene, NRR responds to macronutrient deficiency and regulates root growth," *Mol Plant*, 5(1):63-72 (2012).
Zhang et al., "Agrobacterium-mediated transformation of *Arabidopsis thaliana* using the floral dip method," *Nature Protocols*, 1(2):1-6 (2006).
Zhang et al., "Cationic lipids and polymers mediated vectors for delivery of siRNA," *Journal of Controlled Release*, 123:1-10 (2007).
Zhang et al., "DEG: a database of essential genes," *Nucleic Acids Res.*, 32:D271-D272 (2004).
Zhang et al., "Transgenic rice plants produced by electroporation-mediated plasmid uptake into protoplasts," *The Plant Cell Rep.*, 7:379-384 (1988).
Zhao et al.,"*Phyllotreta striolata* (Coleoptera: Chrysomelidae):Arginine kinase cloning and RNAi-based pest control," *European Journal of Entomology*, 105(5):815-822 (2008).
Zhu et al., "Ingested RNA interference for managing the populations of the Colorado potato beetle, *Leptinotarsa decemlineata," Pest Manag Sci*, 67:175-182 (2010).
Agrios, *Plant Pathology* (Second Edition), 2:466-470 (1978).
Bai et al., "Naturally Occurring Broad-Spectrum Powdery Mildew Resistance in a Central American Tomato Accession Is Caused by Loss of *Mlo* Function," *MPMI*, 21(1):30-39 (2008).
Bourgeois et al., "Field and producer survey of ACCase resistant wild oat in Manitoba," *Canadian Journal of Plant Science*, 709-715 (1997).
Brugière et al., "Glutamine Synthetase in the Phloem Plays a Major Role in Controlling Proline Production," *The Plant Cell*, 11:1995-2011 (1999).
Campbell et al., "Gene-knockdown in the honey bee mite *Varroa destructor* by a non-invasive approach: studies on a glutathione S-transferase," *Parasites & Vectors*, 3(1):73, pp. 1-10 (2010).

(56) References Cited

OTHER PUBLICATIONS

Chang et al., "Cellular Internalization of Fluorescent Proteins via Arginine-rich Intracellular Delivery Peptide in Plant Cells," *Plant Cell Physiol.*, 46(3):482-488 (2005).
Chupp et al., "Chapter 8: White Rust," *Vegetable Diseases and Their Control*, The Ronald Press Company, New York, pp. 267-269 (1960).
Communication pursuant to Article 94(3) EPC dated Jun. 26, 2015, as received in European Patent Application No. 11 753 916.3.
Desai et al., "Reduction in deformed wing virus infection in larval and adult honey bees (*Apis mellifera* L.) by double-stranded RNA ingestion," *Insect Molecular Biology*, 21(4):446-455 (2012).
Emery et al., "Radial Patterning of *Arabidopsis* Shoots by Class III HD-ZIP and KANADI Genes," *Current Biology*, 13:1768-1774 (2003).
Extended European Search Report dated Jun. 29, 2015, in European Patent Application No. 12 831 494.5.
International Preliminary Report on Patentability (Chapter II) mailed Jul. 24, 2015, in International Application No. PCT/US2014/047204.
International Search Report and Written Opinion mailed Mar. 26, 2015, in International Application No. PCT/US2014/069353.
International Search Report and Written Opinion mailed Jul. 8, 2015, in International Application No. PCT/US2015/011408.
Khan et al., "Matriconditioning of Vegetable Seeds to Improve Stand Establishment in Early Field Plantings," *J. Amer. Soc. Hort. Sci.*, 117(1):41-47 (1992).
Kim et al., "Synthetic dsRNA Dicer substrates enhance RNAi potency and efficacy," *Nature Biotechnology*, 23(2):222-226 (2005).
Leopold et al., "Chapter 4: Moisture as a Regulator of Physiological Reaction in Seeds," *Seed Moisture, CSSA Special Publication No. 14*, pp. 51-69 (1989).
MacKenzie et al., "Transgenic *Nicotiana debneyii* expressing viral coat protein are resistant to potato virus S infection," *Journal of General Virology*, 71:2167-2170 (1990).
Maori et al., "IAPV, a bee-affecting virus associated with Colony Collapse Disorder can be silenced by dsRNA ingestion," *Insect Molecular Biology*, 18(1):55-60 (2009).
Non-Final Office Action dated May 15, 2015, in U.S. Appl. No. 14/608,951.
Non-Final Office Action dated Mar. 30, 2015, in U.S. Appl. No. 13/583,302.
Non-Final Office Action dated Jun. 5, 2015, in U.S. Appl. No. 13/612,948.
Non-Final Office Action dated Jun. 8, 2015, in U.S. Appl. No. 13/612,941.
Non-Final Office Action dated Jul. 23, 2015, in U.S. Appl. No. 14/335,135.
Non-Final Office Action dated Aug. 12, 2015, in U.S. Appl. No. 13/612,936.
Non-Final Office Action dated Aug. 13, 2015, in U.S. Appl. No. 13/612,929.
Orbović et al., "Foliar-Applied Surfactants and Urea Temporarily Reduce Carbon Assimilation of Grapefruit Leaves," *J. Amer. Soc. Hort. Sci.*, 126(4):486-490 (2001).
Restriction Requirement dated Oct. 21, 2014, in U.S. Appl. No. 13/583,302.
Restriction Requirement dated May 7, 2015, in U.S. Appl. No. 13/612,925.
Restriction Requirement dated Apr. 21, 2015, in U.S. Appl. No. 13/612,954.
Restriction Requirement dated May 7, 2015, in U.S. Appl. No. 13/612,995.
Restriction Requirement dated May 4, 2015, in U.S. Appl. No. 13/612,929.
Restriction Requirement dated Mar. 12, 2015, in U.S. Appl. No. 13/612,948.
Restriction Requirement dated Mar. 4, 2015, in U.S. Appl. No. 13/612,941.
Restriction Requirement dated May 5, 2015, in U.S. Appl. No. 13/612,936.
Riggins et al., "Characterization of *de novo* transcriptome for waterhemp (*Amaranthus tuberculatus*) using GS-FLX 454 pyrosequencing and its application for studies of herbicide target-site genes," *Pest Manag. Sci.*, 66:1042-1052 (2010).
Rose et al., "Functional polarity is introduced by Dicer processing of short substrate RNAs," *Nucleic Acids Research*, 33(13):4140-4156 (2005).
Rothnie et al., Pararetroviruses and Retroviruses: A Comparative Review of Viral Structure and Gene Expression Strategies, *Advances in Virus Research*, 44:1-67 (1994).
Schweizer et al., "Double-stranded RNA interferes with gene function at the single-cell level in cereals," *The Plant Journal*, 24(6):895-903 (2000).
Senthil-Kumar et al., "A systematic study to determine the extent of gene silencing in *Nicotiana benthamiana* and other *Solanaceae* species when heterologous gene sequences are used for virus-induced gene silencing," *New Phytologist*, 176:782-791 (2007).
Snead et al., "Molecular basis for improved gene silencing by Dicer substrate interfering RNA compared with other siRNA variants," *Nucleic Acids Research*, 41(12):6209-6221 (2013).
Stevens et al., "New Formulation Technology—SILWET® Organosilicone Surfactants Have Physical and Physiological Properties Which Enhance the Performance of Sprays," *Proceedings of the 9th Australian Weeds Conference*, pp. 327-331 (1990).
Sutton et al., "Activity of mesotrione on resistant weeds in maize," *Pest Manag. Sci.*, 58:981-984 (2002).
Tank Mixing Chemicals Applied to Peanut Crops: Are the Chemicals Compatible?, College of Agriculture & Life Sciences, NC State University, AGW-653, pp. 1-11 (2004).
Taylor, "Seed Storage, Germination and Quality," *The Physiology of Vegetable Crops*, pp. 1-36 (1997).
Tranel et al., "Resistance of weeds to ALS-inhibiting herbicides: what have we learned?," *Weed Science*, 50:700-712 (2002).
Vermeulen et al., "The contributions of dsRNA structure to Dicer specificity and efficiency," *RNA*, 11(5):674-682 (2005).
Final Office Action dated Nov. 7, 2013, in U.S. Appl. No. 13/042,856.
First Office Action issued May 27, 2015, in Chinese Patent Application No. 201280054179.8.
Non-Final Office Action dated Apr. 11, 2013, in U.S. Appl. No. 13/042,856.
Non-Final Office Action dated Jul. 30, 2014, in U.S. Appl. No. 13/042,856.
Restriction Requirement dated Oct. 2, 2012, in U.S. Appl. No. 13/042,856.

* cited by examiner

METHODS AND COMPOSITIONS FOR WEED CONTROL

This application claims benefit under 35 USC §119(e) of U.S. provisional application Ser. No. 61/534,086 filed Sep. 13, 2011, herein incorporated by reference in it's entirety. The sequence listing that is contained in the file named "40_21_58640_B_seqlisting_SUB_04132015.txt", which is 862,450 bytes (measured in operating system MS-Windows) and was created on Apr. 13, 2015, is filed herewith and incorporated herein by reference.

Table 1 is provided herewith as a part of this U.S. patent application via the USPTO's EFS system in file named "40_21(58640)Btable1.doxc" which is 61,788 bytes in size (measured in MS-Windows®). Table 1 (file "40_21(58640) Btable1.doxc" comprises 71 sequences and is herein incorporated by reference in its entirety.

Table 2 is provided herewith as a part of this U.S. patent application via the USPTO's EFS system in file named "40_21(58640)Btable2.doxc" which is 161,884 bytes in size (measured in MS-Windows®). Table 2 (file "40_21(58640) Btable2.doxc" comprises 1268 sequences and is herein incorporated by reference in its entirety.

Table 3 is provided herewith as a part of this U.S. patent application via the USPTO's EFS system in file named "40_21(58640)Btable3.txt" which is 41,120 bytes in size (measured in MS-Windows®). Table 2 (file "40_21(58640) Btable3.txt" comprises 832 sequences and is herein incorporated by reference in its entirety.

FIELD

The methods and compositions generally relates to the field of weed management. More specifically, relates to protoporphyrinogen IX oxidase (PPG oxidase) genes in plants and compositions containing polynucleotide molecules for modulating and/or regulating their expression. Further provided are methods and compositions useful for weed control.

BACKGROUND

Weeds are plants that compete with cultivated plants in an agronomic environment and cost farmers billions of dollars annually in crop losses and the expense of efforts to keep weeds under control. Weeds also serve as hosts for crop diseases and insect pests. The losses caused by weeds in agricultural production environments include decreases in crop yield, reduced crop quality, increased irrigation costs, increased harvesting costs, reduced land value, injury to livestock, and crop damage from insects and diseases harbored by the weeds. The principal means by which weeds cause these effects are: 1) competing with crop plants for water, nutrients, sunlight and other essentials for growth and development, 2) production of toxic or irritant chemicals that cause human or animal health problem, 3) production of immense quantities of seed or vegetative reproductive parts or both that contaminate agricultural products and perpetuate the species in agricultural lands, and 4) production on agricultural and nonagricultural lands of vast amounts of vegetation that must be disposed of Herbicide tolerant weeds are a problem with nearly all herbicides in use, there is a need to effectively manage these weeds. There are over 365 weed biotypes currently identified as being herbicide resistant to one or more herbicides by the Herbicide Resistance Action Committee (HRAC), the North American Herbicide Resistance Action Committee (NAHRAC), and the Weed Science Society of America (WSSA).

BRIEF DESCRIPTION OF THE FIGURES

The following drawings form part of the present specification and are included to further demonstrate certain methods, compositions or results. They may be better understood by reference to one or more of these drawings in combination with the detailed description of specific embodiments presented herein. The invention can be more fully understood from the following description of the figures.

SUMMARY

Figure 1:
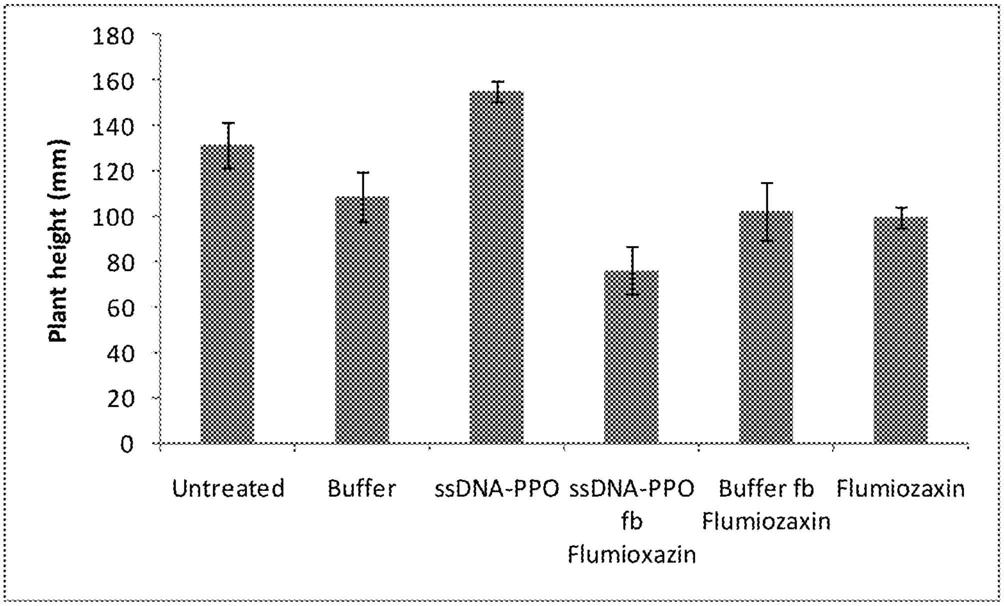
FIG. 1. Treatment of *Amaranthus palmeri* with ssDNA trigger polynucleotides and PPG oxidase inhibitor herbicide, flumioxazin.

In one aspect, the invention provides a method of plant control comprising an external application to a plant of a composition comprising a polynucleotide and a transfer agent, wherein the polynucleotide is essentially identical or essentially complementary to a PPG oxidase gene sequence or fragment thereof, or to the RNA transcript of said PPG oxidase gene sequence or fragment thereof, wherein said PPG oxidase gene sequence is selected from the group consisting of SEQ ID NO:1-71 or a polynucleotide fragment thereof, whereby the plant growth or development or reproductive ability is reduced or the weedy plant is made more sensitive to a PPG oxidase inhibitor herbicide relative to a plant not treated with said composition. In this manner, plants that have become resistant to the application of PPG oxidase inhibitor containing herbicides may be made more susceptible to the herbicidal effects of a PPG oxidase inhibitor containing herbicide, thus potentiating the effect of the herbicide. The polynucleotide fragment is at least 18 contiguous nucleotides, at least 19 contiguous nucleotides, at least 20 contiguous nucleotides or at least 21 contiguous nucleotides in length and at least 85 percent identical to a PPG oxidase gene sequence selected from the group consisting of SEQ ID NO:1-71 and the transfer agent is an organosilicone composition or compound. The polynucleotide fragment can also be sense or anti-sense ssDNA or ssRNA, dsRNA, or dsDNA, or dsDNA/RNA hybrids. The composition can include more than one polynucleotide fragments, and the composition can include a PPG oxidase inhibitor herbicide and/or other herbicides that enhance the weed control activity of the composition.

In another aspect, polynucleotide molecules and methods for modulating PPG oxidase gene expression in weedy plant species are provided. The method reduces, represses or otherwise delays expression of a PPG oxidase gene in a weedy plant comprising an external application to a weedy plant of a composition comprising a polynucleotide and a transfer agent, wherein the polynucleotide is essentially identical or essentially complementary to a PPG oxidase gene sequence or fragment thereof, or to the RNA transcript of the PPG oxidase gene sequence or fragment thereof, wherein the PPG oxidase gene sequence is selected from the group consisting of SEQ ID NO:1-71 or a polynucleotide fragment thereof. The polynucleotide fragment is at least 18 contiguous nucleotides, at least 19 contiguous nucleotides, at least 20 contiguous nucleotides at least 21 contiguous nucleotides in length and at least 85 percent identical to a PPG oxidase gene sequence selected from the group consisting of SEQ ID NO:1-71 and the transfer agent is an organosilicone compound. The polynucleotide fragment can also be sense or anti-sense ssDNA or ssRNA, dsRNA, or dsDNA, or dsDNA/RNA hybrids.

In a further aspect, the polynucleotide molecule containing composition may be combined with other herbicidal compounds to provide additional control of unwanted plants in a field of cultivated plants.

In a further aspect, the polynucleotide molecule composition may be combined with any one or more additional agricultural chemicals, such as, insecticides, fungicides, nematocides, bactericides, acaricides, growth regulators, chemosterilants, semiochemicals, repellents, attractants, pheromones, feeding stimulants, biopesticides, microbial pesticides or other biologically active compounds to form a multi-component pesticide giving an even broader spectrum of agricultural protection.

DETAILED DESCRIPTION

Provided are methods and compositions containing a polynucleotide that provide for regulation, repression or delay of PPG oxidase (protoporphyrinogen IX oxidase) gene expression and enhanced control of weedy plant species and importantly PPG oxidase inhibitor resistant weed biotypes. Aspects of the method can be applied to manage various weedy plants in agronomic and other cultivated environments.

The following definitions and methods are provided to better define the present invention and to guide those of ordinary skill in the art in the practice of the present invention. Unless otherwise noted, terms are to be understood according to conventional usage by those of ordinary skill in the relevant art. Where a term is provided in the singular, the inventors also contemplate aspects of the invention described by the plural of that term.

By "non-transcribable" polynucleotides is meant that the polynucleotides do not comprise a complete polymerase II transcription unit.

As used herein "solution" refers to homogeneous mixtures and non-homogeneous mixtures such as suspensions, colloids, micelles, and emulsions.

Weedy plants are plants that compete with cultivated plants, those of particular importance include, but are not limited to important invasive and noxious weeds and herbicide resistant biotypes in crop production, such as, *Amaranthus* species—*A. albus, A. blitoides, A. hybridus, A. palmeri, A. powellii, A. retroflexus, A. spinosus, A. tuberculatus*, and *A. viridis; Ambrosia* species—*A. trifida, A. artemisifolia; Lolium* species—*L. multiflorum, L. rigidium, L. perenne; Digitaria* species—*D. insularis; Euphorbia* species—*E. heterophylla; Kochia* species—*K. scoparia; Sorghum* species—*S. halepense; Conyza* species—*C. bonariensis, C. canadensis, C. sumatrensis; Chloris* species—*C. truncate; Echinochola* species—*E. colona, E. crus-galli; Eleusine* species—*E. indica; Poa* species—*P. annua; Plantago* species—*P. lanceolata; Avena* species—*A. fatua; Chenopodium* species—*C. album; Setaria* species—*S. viridis, Abutilon theophrasti, Ipomoea* species, *Sesbania*, species, *Cassia* species, *Sida* species, *Brachiaria*, species and *Solanum* species.

Additional weedy plant species found in cultivated areas include *Alopecurus myosuroides, Avena sterilis, Avena sterilis ludoviciana, Brachiaria plantaginea, Bromus diandrus, Bromus rigidus, Cynosurus echinatus, Digitaria ciliaris, Digitaria ischaemum, Digitaria sanguinalis, Echinochloa oryzicola, Echinochloa phyllopogon, Eriochloa punctata, Hordeum glaucum, Hordeum leporinum, Ischaemum rugosum, Leptochloa chinensis, Lolium persicum, Phalaris minor, Phalaris paradoxa, Rottboellia exalta, Setaria faberi, Setaria viridis* var, *robusta-alba schreiber, Setaria viridis* var, *robusta-purpurea, Snowdenia polystachea, Sorghum sudanese, Alisma plantago-aquatica, Amaranthus lividus, Amaranthus quitensis, Ammania auriculata, Ammania coccinea, Anthemis cotula, Apera spica-venti, Bacopa rotundifolia, Bidens pilosa, Bidens subalternans, Brassica tournefortii, Bromus tectorum, Camelina microcarpa, Chrysanthemum coronarium, Cuscuta campestris, Cyperus difformis, Damasonium minus, Descurainia sophia, Diplotaxis tenuifolia, Echium plantagineum, Elatine triandra* var, *pedicellate, Euphorbia heterophylla, Fallopia convolvulus, Fimbristylis miliacea, Galeopsis tetrahit, Galium spurium, Helianthus annuus, Iva xanthifolia, Ixophorus unisetus, Ipomoea indica, Ipomoea purpurea, Ipomoea sepiaria, Ipomoea aquatic, Ipomoea triloba, Lactuca serriola, Limnocharis flava, Limnophila erecta, Limnophila sessiliflora, Lindernia dubia, Lindernia dubia* var, *major, Lindernia micrantha, Lindernia procumbens, Mesembryanthemum crystallinum, Monochoria korsakowii, Monochoria vaginalis, Neslia paniculata, Papaver rhoeas, Parthenium hysterophorus, Pentzia suffruticosa, Phalaris minor, Raphanus raphanistrum, Raphanus sativus, Rapistrum rugosum, Rotala indica* var, *uliginosa, Sagittaria guyanensis, Sagittaria montevidensis, Sagittaria pygmaea, Salsola iberica, Scirpus juncoides* var, *ohwianus, Scirpus mucronatus, Setaria lutescens, Sida spinosa, Sinapis arvensis, Sisymbrium orientale, Sisymbrium thellungii, Solanum ptycanthum, Sonchus asper, Sonchus oleraceus, Sorghum bicolor, Stellaria media, Thlaspi arvense, Xanthium strumarium, Arctotheca calendula, Conyza sumatrensis, Crassocephalum crepidiodes, Cuphea carthagenenis, Epilobium adenocaulon, Erigeron philadelphicus, Landoltia punctata, Lepidium virginicum, Monochoria korsakowii, Solanum americanum, Solanum nigrum, Vulpia bromoides, Youngia japonica, Hydrilla verticillate, Carduus nutans, Carduus pycnocephalus, Centaurea solstitialis, Cirsium arvense, Commelina diffusa, Convolvulus arvensis, Daucus carota, Digitaria ischaemum, Echinochloa crus-pavonis, Fimbristylis miliacea, Galeopsis tetrahit, Galium spurium, Limnophila erecta, Matricaria perforate, Papaver rhoeas, Ranunculus acris, Soliva sessilis, Sphenoclea zeylanica, Stellaria media, Nassella trichotoma, Stipa neesiana, Agrostis stolonifera, Polygonum aviculare, Alopecurus japonicus, Beckmannia syzigachne, Bromus tectorum, Chloris inflate, Echinochloa erecta, Portulaca oleracea*, and *Senecio vulgaris*. It is believed that all plants contain an protoporphyrinogen IX oxidase gene in their genome, the sequence of which can be isolated and polynucleotides made according to the methods of the present invention that are useful for regulating, suppressing or delaying the expression of the target PPG oxidase gene in the plants and the growth or development of the treated plants.

Some cultivated plants may also be weedy plants when they occur in unwanted environments. Transgenic crops with one or more herbicide tolerances will need specialized methods of management to control weeds and volunteer crop plants and to target the herbicide tolerance transgene as necessary to permit the treated plants to become sensitive to the herbicide.

A "trigger" or "trigger polynucleotide" is a polynucleotide molecule that is homologous or complementary to a target gene polynucleotide. The trigger polynucleotide molecules modulate expression of the target gene when topically applied to a plant surface with a transfer agent, whereby a plant treated with said composition has its growth or development or reproductive ability regulated, suppressed or delayed or said plant is more sensitive to a PPG oxidase inhibitor herbicide or mitosis inhibitor herbicide as a result of said polynucleotide containing composition relative to a plant not treated with a composition containing the trigger molecule. Trigger polynucleotides disclosed herein are generally described in relation to the target gene sequence and maybe used in the sense (homologous) or antisense (complementary) orientation as single stranded molecules or comprise both strands as double stranded molecules or nucleotide variants and modified nucleotides thereof depending on the various regions of a gene being targeted.

It is contemplated that the composition of the present invention will contain multiple polynucleotides and herbicides that include but not limited to PPG oxidase gene trigger polynucleotides and a PPG oxidase inhibitor herbicide and anyone or more additional herbicide target gene trigger polynucleotides and the related herbicides and anyone or more additional essential gene trigger polynucleotides. Essential genes are genes in a plant that provide key enzymes or other proteins, for example, a biosynthetic enzyme, metabolizing enzyme, receptor, signal transduction protein, structural gene product, transcription factor, or transport protein; or regulating RNAs, such as, microRNAs, that are essential to the growth or survival of the organism or cell or involved in the normal growth and development of the plant (Meinke, et al., Trends Plant Sci. 2008 September; 13(9):483-91). The suppression of an essential gene enhances the effect of a herbicide that affects the function of a gene product different than the suppressed essential gene. The compositions of the present invention can include various trigger polynucleotides that modulate the expression of an essential gene other the PPG oxidase.

Herbicides for which transgenes for plant tolerance have been demonstrated and the method of the present invention can be applied, include but are not limited to: auxin-like herbicides, glyphosate, glufosinate, sulfonylureas, imidazolinones, bromoxynil, delapon, dicamba, cyclohezanedione, protoporphyrionogen oxidase inhibitors, 4-hydroxyphenylpyruvate-dioxygenase inhibitors herbicides. For example, transgenes and their polynucleotide molecules that encode proteins involved in herbicide tolerance are known in the art, and include, but are not limited to an 5-enolpyruvylshikimate-3-phosphate synthase (EPSPS), for example, as more fully described in U.S. Pat. No. 7,807,791 (SEQ ID NO:5); U.S. Pat. Nos. 6,248,876 B1; 5,627,061; 5,804,425; 5,633,435; 5,145,783; 4,971,908; 5,462,910; 5,188,642; 4,940,835; 5,866,775; 6,225,114 B1; 6,130,366; 5,460,667; 4,535,060; 4,769,061; 5,633,448; 5,510,471; U.S. Pat. No. Re. 36,449; U.S. Pat. Nos. RE 37,287 E; and 5,491,288; tolerance to sulfonylurea and/or imidazolinone, for example, as described more fully in U.S. Pat. Nos. 5,605,011; 5,013,659; 5,141,870; 5,767,361; 5,746,180; 5,304,732; 4,761,373; 5,346,107; 5,928,937; and 5,378,824; and international publication WO 96/33270; tolerance to hydroxyphenylpyruvatedioxygenases inhibition herbicides in plants are described in U.S. Pat. Nos. 6,245,968 B1; 6,268,549; and 6,069,115; US Pat. Pub. 20110191897 and U.S. Pat. No. 7,462,379 SEQ ID NO:3; U.S. Pat. No. 7,935,869; U.S. Pat. No. 7,304,209, SEQ ID NO:1, 3, 5 and 15; aryloxyalkanoate dioxygenase polynucleotides, which confer tolerance to 2,4-D and other phenoxy auxin herbicides as well as to aryloxyphenoxypropionate herbicides as described, for example, in WO2005/107437; U.S. Pat. No. 7,838,733 SEQ ID NO:5;) and dicamba-tolerance polynucleotides as described, for example, in Herman et al. (2005) J. Biol. Chem. 280: 24759-24767. Other examples of herbicide-tolerance traits include those conferred by polynucleotides encoding an exogenous phosphinothricin acetyltransferase, as described in U.S. Pat. Nos. 5,969,213; 5,489,520; 5,550,468; 5,874,265; 5,919,675; 5,561,236; 5,648,477; 5,646,024; 6,177,616; and 5,879,903. Plants containing an exogenous phosphinothricin acetyltransferase can exhibit improved tolerance to glufosinate herbicides, which inhibit the enzyme glutamine synthase. Additionally, herbicide-tolerance polynucleotides include those conferred by polynucleotides conferring altered protoporphyrinogen oxidase (protox) activity, as described in U.S. Pat. Nos. 6,288,306 B1; 6,282,837 B1; and 5,767,373; and WO 01/12825. Plants containing such polynucleotides can exhibit improved tolerance to any of a variety of herbicides which target the protox enzyme (also referred to as protox inhibitors). Polynucleotides encoding a glyphosate oxidoreductase and a glyphosate-N-acetyl transferase (GOX described in U.S. Pat. No. 5,463,175 and GAT described in U.S. Patent publication 20030083480, dicamba monooxygenase U.S. Patent publication 20030135879, all of which are incorporated herein by reference); a polynucleotide molecule encoding bromoxynil nitrilase (Bxn described in U.S. Pat. No. 4,810,648 for Bromoxynil tolerance, which is incorporated herein by reference); a polynucleotide molecule encoding phytoene desaturase (crtI) described in Misawa et al, (1993) *Plant J.* 4:833-840 and Misawa et al, (1994) *Plant J.* 6:481-489 for norflurazon tolerance; a polynucleotide molecule encoding acetohydroxyacid synthase (AHAS, aka ALS) described in Sathasiivan et al. (1990) *Nucl. Acids Res.* 18:468-2193 for tolerance to sulfonylurea herbicides; and the bar gene described in DeBlock, et al. (1987) *EMBO J.* 6:2513-2519 for glufosinate and bialaphos tolerance. The transgenic coding regions and regulatory elements of the herbicide tolerance genes are targets in which polynucleotide triggers and herbicides can be included in the composition of the present invention.

The composition includes a component that is a PPG oxidase inhibitor herbicide, which include but is not limited to acifluorfen-Na, bifenox, chlomethoxyfen, fluoroglycofen-ethyl, fomesafen, halosafen, lactofen, oxyfluorfen, fluazolate, pyraflufen-ethyl, cinidon-ethyl, flumioxazin, flumiclorac-pentyl, fluthiacet-methyl, thidiazimin, oxadiazon, oxadiargyl, azafenidin, carfentrazone-ethyl, sulfentrazone, pentoxazone. Benzfendizone, butafenacil, pyrazogyl, and profluazol.

Numerous additional herbicides with similar or different modes of action (herein referred to as co-herbicides) are available that can be added to the composition, for example, members of the herbicide families that include but are not limited to amide herbicides, aromatic acid herbicides, arsenical herbicides, benzothiazole herbicides, benzoylcyclohexanedione herbicides, benzofuranyl alkylsulfonate herbicides, carbamate herbicides, cyclohexene oxime herbicides, cyclopropylisoxazole herbicides, dicarboximide herbicides, dinitroaniline herbicides, dinitrophenol herbicides, diphenyl ether herbicides, dithiocarbamate herbicides, halogenated aliphatic herbicides, imidazolinone herbicides, inorganic herbicides, nitrile herbicides, organophosphorus herbicides, oxadiazolone herbicides, oxazole herbicides, phenoxy herbicides, phenylenediamine herbicides, pyrazole herbicides, pyridazine herbicides, pyridazinone herbicides, pyridine herbicides, pyrimidinediamine herbicides, pyrimidinyloxybenzylamine herbicides, quaternary ammonium herbicides, thiocarbamate herbicides, thiocarbonate herbicides, thiourea herbicides, triazine herbicides, triazinone herbicides, triazole herbicides, triazolone herbicides, triazolopyrimidine herbicides, uracil herbicides, and urea herbicides. In particular, the rates of use of the added herbicides can be reduced in compositions comprising the polynucleotides. Use rate reductions of the additional added herbicides can be 10-25 percent, 26-50 percent, 51-75 percent or more can be achieved that enhance the activity of the polynucleotides and herbicide composition and is contemplated. Representative co-herbicides of the families include but are not limited to acetochlor, acifluorfen, acifluorfen-sodium, aclonifen, acrolein, alachlor, alloxydim, allyl alcohol, ametryn, amicarbazone, amidosulfuron, aminopyralid, amitrole, ammonium sulfamate, anilofos, asulam, atraton, atrazine, azimsulfuron, BCPC, beflubutamid, benazolin, benfluralin, benfuresate, bensulfuron, bensulfuron-methyl, bensulide, bentazone, benzfendizone, benzobicyclon, benzofenap, bifenox, bilanafos, bispyribac, bispyribac-sodium, borax, bromacil, bromobutide, bromoxynil, butachlor, butafenacil, butamifos, butralin, butroxydim, butylate, cacodylic acid, calcium chlorate, cafenstrole, carbetamide, carfentrazone, carfentrazone-ethyl, CDEA, CEPC, chlorflurenol, chlorflurenol-methyl, chloridazon, chlorimuron, chlorimuron-ethyl, chloroacetic acid, chlorotoluron, chlorpropham, chlorsulfuron, chlorthal, chlorthal-dimethyl, cinidon-ethyl, cinmethylin, cinosulfuron, cisanilide, clethodim, clodinafop, clodinafop-propargyl, clomazone, clomeprop, clopyralid, cloransulam, cloransulam-methyl, CMA, 4-CPB, CPMF, 4-CPP, CPPC, cresol, cumyluron, cyanamide, cyanazine, cycloate, cyclosulfamuron, cycloxydim, cyhalofop, cyhalofop-butyl, 2,4-D, 3,4-DA, daimuron, dalapon, dazomet, 2,4-DB, 3,4-DB, 2,4-DEB, desmedipham, dicamba, dichlobenil, ortho-dichlorobenzene, para-dichlorobenzene, dichlorprop, dichlorprop-P, diclofop, diclofop-methyl, diclosulam, difenzoquat, difenzoquat metilsulfate, diflufenican, diflufenzopyr, dimefuron, dimepiperate, dimethachlor, dimethametryn, dimethenamid, dimethenamid-P, dimethipin, dimethylarsinic acid, dinitramine, dinoterb, diphenamid, diquat, diquat dibromide, dithiopyr, diuron, DNOC, 3,4-DP, DSMA, EBEP, endothal, EPTC, esprocarb, ethalfluralin, ethametsulfuron, ethametsulfuron-methyl, ethofumesate, ethoxyfen, ethoxysulfuron, etobenzanid, fenoxaprop-P, fenoxaprop-P-ethyl, fentrazamide, ferrous sulfate, flamprop-M, flazasulfuron, florasulam, fluazifop, fluazifop-butyl, fluazifop-P, fluazifop-P-butyl, flucarbazone, flucarbazone-sodium, flucetosulfuron, fluchloralin, flufenacet, flufenpyr, flufenpyr-ethyl, flumetsulam, flumiclorac, flumiclorac-pentyl, flumioxazin, fluometuron, fluoroglycofen, fluoroglycofen-ethyl, flupropanate, flupyrsulfuron, flupyrsulfuron-methyl-sodium, flurenol, fluridone, fluorochloridone, fluoroxypyr, flurtamone, fluthiacet, fluthiacet-methyl, fomesafen, foramsulfuron, fosamine, glufosinate, glufosinate-ammonium, glyphosate, halosulfuron, halosulfuron-methyl, haloxyfop, haloxyfop-P, HC-252, hexazinone, imazamethabenz, imazamethabenz-methyl, imazamox, imazapic, imazapyr, imazaquin, imazethapyr, imazosulfuron, indanofan, iodomethane, iodosulfuron, iodosulfuron-methyl-sodium, ioxynil, isoproturon, isouron, isoxaben, isoxachlortole, isoxaflutole, karbutilate, lactofen, lenacil, linuron, MAA, MAMA, MCPA, MCPA-thioethyl, MCPB, mecoprop, mecoprop-P, mefenacet, mefluidide, mesosulfuron, mesosulfuron-methyl, mesotrione, metam, metamifop, metamitron, metazachlor, methabenzthiazuron, methylarsonic acid, methyldymron, methyl isothiocyanate, metobenzuron, metolachlor, S-metolachlor, metosulam, metoxuron, metribuzin, metsulfuron, metsulfuron-methyl, MK-66, molinate, monolinuron, MSMA, naproanilide, napropamide, naptalam, neburon, nicosulfuron, nonanoic acid, norflurazon, oleic acid (fatty acids), orbencarb, orthosulfamuron, oryzalin, oxadiargyl, oxadiazon, oxasulfuron, oxaziclomefone, oxyfluorfen, paraquat, paraquat dichloride, pebulate, pendimethalin, penoxsulam, pentachlorophenol, pentanochlor, pentoxazone, pethoxamid, petrolium oils, phenmedipham, phenmedipham-ethyl, picloram, picolinafen, pinoxaden, piperophos, potassium arsenite, potassium azide, pretilachlor, primisulfuron, primisulfuron-methyl, prodiamine, profluazol, profoxydim, prometon, prometryn, propachlor, propanil, propaquizafop, propazine, propham, propisochlor, propoxycarbazone, propoxycarbazone-sodium, propyzamide, prosulfocarb, prosulfuron, pyraclonil, pyraflufen, pyraflufen-ethyl, pyrazolynate, pyrazosulfuron, pyrazosulfuron-ethyl, pyrazoxyfen, pyribenzoxim, pyributicarb, pyridafol, pyridate, pyriftalid, pyriminobac, pyriminobac-methyl, pyrimisulfan, pyrithiobac, pyrithiobac-sodium, quinclorac, quinmerac, quinoclamine, quizalofop, quizalofop-P, rimsulfuron, sethoxydim, siduron, simazine, simetryn, SMA, sodium arsenite, sodium azide, sodium chlorate, sulcotrione, sulfentrazone, sulfometuron, sulfometuron-methyl, sulfosate, sulfosulfuron, sulfuric acid, tar oils, 2,3,6-TBA, TCA, TCA-sodium, tebuthiuron, tepraloxydim, terbacil, terbumeton, terbuthylazine, terbutryn, thenylchlor, thiazopyr, thifensulfuron, thifensulfuron-methyl, thiobencarb, tiocarbazil, topramezone, tralkoxydim, tri-allate, triasulfuron, triaziflam, tribenuron, tribenuron-methyl, tricamba, triclopyr, trietazine, trifloxysulfuron, trifloxysulfuron-sodium, trifluralin, triflusulfuron, triflusulfuron-methyl, trihydroxytriazine, tritosulfuron, [3-[2-chloro-4-fluoro-5-(-methyl-6-trifluoromethyl-2,4-dioxo-,2,3,4-t-etrahydropyrimidin-3-yl)phenoxy]-2-pyridyloxy]acetic acid ethyl ester (CAS RN 353292-3-6), 4-[(4,5-dihydro-3-methoxy-4-methyl-5-oxo)-H-,2,4-triazol-1-ylcarbonyl-sulfamoyl]-5-methylthiophene-3-carboxylic acid (BAY636), BAY747 (CAS RN 33504-84-2), topramezone (CAS RN 2063-68-8), 4-hydroxy-3-[[2-[(2-methoxyethoxy)methyl]-6-(trifluoro-methyl)-3-pyridi-nyl]carbonyl]-bicyclo[3.2.]oct-3-en-2-one (CAS RN 35200-68-5), and 4-hydroxy-3-[[2-(3-methoxypropyl)-6-(difluoromethyl)-3-pyridinyl]carbon-yl]-bicyclo[3.2.]oct-3-en-2-one. Additionally, including herbicidal compounds of unspecified modes of action as described in CN101279950A, CN101279951A, DE10000600A1, DE10116399A1, DE102004054666A1, DE102005014638A1, DE102005014906A1, DE102007012168A1, DE102010042866A1, DE10204951A1, DE10234875A1, DE10234876A1, DE10256353A1, DE10256354A1, DE10256367A1, EP1157991A2, EP1238586A1, EP2147919A1, EP2160098A2, JP03968012B2, JP2001253874A, JP2002080454A, JP2002138075A, JP2002145707A, JP2002220389A, JP2003064059A, JP2003096059A, JP2004051628A, JP2004107228A, JP2005008583A, JP2005239675A, JP2005314407A, JP2006232824A, JP2006282552A, JP2007153847A, JP2007161701A, JP2007182404A, JP2008074840A, JP2008074841A, JP2008133207A, JP2008133218A, JP2008169121A, JP2009067739A, JP2009114128A, JP2009126792A, JP2009137851A, US20060111241A1, US20090036311A1, US20090054240A1, US20090215628A1, US20100099561A1, US20100152443A1, US20110105329A1, US20110201501A1, WO2001055066A2, WO2001056975A1, WO2001056979A1, WO2001090071A2, WO2001090080A1, WO2002002540A1, WO2002028182A1, WO2002040473A1, WO2002044173A2, WO2003000679A2, WO2003006422A1, WO2003013247A1, WO2003016308A1, WO2003020704A1, WO2003022051A1, WO2003022831A1, WO2003022843A1, WO2003029243A2, WO2003037085A1, WO2003037878A1, WO2003045878A2, WO2003050087A2, WO2003051823A1, WO2003051824A1, WO2003051846A2, WO2003076409A1, WO2003087067A1, WO2003090539A1, WO2003091217A1, WO2003093269A2, WO2003104206A2, WO2004002947A1, WO2004002981A2, WO2004011429A1, WO2004029060A1, WO2004035545A2, WO2004035563A1, WO2004035564A1, WO2004037787A1, WO2004067518A1, WO2004067527A1, WO2004077950A1, WO2005000824A1, WO2005007627A1, WO2005040152A1, WO2005047233A1, WO2005047281A1, WO2005061443A2, WO2005061464A1, WO2005068434A1, WO2005070889A1, WO2005089551A1, WO2005095335A1, WO2006006569A1, WO2006024820A1, WO2006029828A1, WO2006029829A1, WO2006037945A1, WO2006050803A1, WO2006090792A1, WO2006123088A2, WO2006125687A1, WO2006125688A1, WO2007003294A1, WO2007026834A1, WO2007071900A1, WO2007077201A1, WO2007077247A1, WO2007096576A1, WO2007119434A1, WO2007134984A1, WO2008009908A1, WO2008029084A1, WO2008059948A1, WO2008071918A1, WO2008074991A1, WO2008084073A1, WO2008100426A2, WO2008102908A1, WO2008152072A2, WO2008152073A2, WO2009000757A1, WO2009005297A2, WO2009035150A2, WO2009063180A1, WO2009068170A2, WO2009068171A2, WO2009086041A1, WO2009090401A2, WO2009090402A2, WO2009115788A1, WO2009116558A1, WO2009152995A1, WO2009158258A1, WO2010012649A1, WO2010012649A1, WO2010026989A1, WO2010034153A1, WO2010049270A1, WO2010049369A1, WO2010049405A1, WO2010049414A1, WO2010063422A1, WO2010069802A1, WO2010078906A2, WO2010078912A1, WO2010104217A1, WO2010108611A1, WO2010112826A3, WO2010116122A3, WO2010119906A1, WO2010130970A1, WO2011003776A2, WO2011035874A1, WO2011065451A1, all of which are incorporated herein by reference.

An agronomic field in need of plant control is treated by application of the composition directly to the surface of the growing plants, such as by a spray. For example, the method is applied to control weeds in a field of crop plants by spraying the field with the composition. The composition can be provided as a tank mix, a sequential treatment of components (generally the polynucleotide containing composition followed by the herbicide), or a simultaneous treatment or mixing of one or more of the components of the composition from separate containers. Treatment of the field can occur as often as needed to provide weed control and the components of the composition can be adjusted to target specific weed species or weed families through utilization of specific polynucleotides or polynucleotide compositions capable of selectively targeting the specific species or plant family to be controlled. The composition can be applied at effective use rates according to the time of application to the field, for example, preplant, at planting, post planting, post harvest. PPG oxidase inhibitor herbicides can be applied to a field at rates of 100 to 500 g ai/ha (active ingredient per hectare) or more. The polynucleotides of the composition can be applied at rates of 1 to 30 grams per acre depending on the number of trigger molecules needed for the scope of weeds in the field.

Crop plants in which weed control is needed include but are not limited to, i) corn, soybean, cotton, canola, sugar beet, alfalfa, sugarcane, rice, and wheat; ii) vegetable plants including, but not limited to, tomato, sweet pepper, hot pepper, melon, watermelon, cucumber, eggplant, cauliflower, broccoli, lettuce, spinach, onion, peas, carrots, sweet corn, Chinese cabbage, leek, fennel, pumpkin, squash or gourd, radish, Brussels sprouts, tomatillo, garden beans, dry beans, or okra; iii) culinary plants including, but not limited to, basil, parsley, coffee, or tea; or, iv) fruit plants including but not limited to apple, pear, cherry, peach, plum, apricot, banana, plantain, table grape, wine grape, citrus, avocado, mango, or berry; v) a tree grown for ornamental or commercial use, including, but not limited to, a fruit or nut tree; or, vi) an ornamental plant (e. g., an ornamental flowering plant or shrub or turf grass). The methods and compositions provided herein can also be applied to plants produced by a cutting, cloning, or grafting process (i. e., a plant not grown from a seed) include fruit trees and plants that include, but are not limited to, citrus, apples, avocados, tomatoes, eggplant, cucumber, melons, watermelons, and grapes as well as various ornamental plants.

Pesticidal Mixtures

The polynucleotide compositions may also be used as mixtures with various agricultural chemicals and/or insecticides, miticides and fungicides, pesticidal and biopesticidal agents. Examples include but are not limited to azinphos-methyl, acephate, isoxathion, isofenphos, ethion, etrimfos, oxydemeton-methyl, oxydeprofos, quinalphos, chlorpyrifos, chlorpyrifos-methyl, chlorfenvinphos, cyanophos, dioxabenzofos, dichlorvos, disulfoton, dimethylvinphos, dimethoate, sulprofos, diazinon, thiometon, tetrachlorvinphos, temephos, tebupirimfos, terbufos, naled, vamidothion, pyraclofos, pyridafenthion, pirimiphos-methyl, fenitrothion, fenthion, phenthoate, flupyrazophos, prothiofos, propaphos, profenofos, phoxime, phosalone, phosmet, formothion, phorate, malathion, mecarbam, mesulfenfos, methamidophos, methidathion, parathion, methyl parathion, monocrotophos, trichlorphon, EPN, isazophos, isamidofos, cadusafos, diamidaphos, dichlofenthion, thionazin, fenamiphos, fosthiazate, fosthietan, phosphocarb, DSP, ethoprophos, alanycarb, aldicarb, isoprocarb, ethiofencarb, carbaryl, carbosulfan, xylylcarb, thiodicarb, pirimicarb, fenobucarb, furathiocarb, propoxur, bendiocarb, benfuracarb, methomyl, metolcarb, XMC, carbofuran, aldoxycarb, oxamyl, acrinathrin, allethrin, esfenvalerate, empenthrin, cycloprothrin, cyhalothrin, gamma-cyhalothrin, lambda-cyhalothrin, cyfluthrin, beta-cyfluthrin, cypermethrin, alpha-cypermethrin, zeta-cypermethrin, silafluofen, tetramethrin, tefluthrin, deltamethrin, tralomethrin, bifenthrin, phenothrin, fenvalerate, fenpropathrin, furamethrin, prallethrin, flucythrinate, fluvalinate, flubrocythrinate, permethrin, resmethrin, ethofenprox, cartap, thiocyclam, bensultap, acetamiprid, imidacloprid, clothianidin, dinotefuran, thiacloprid, thiamethoxam, nitenpyram, chlorfluazuron, diflubenzuron, teflubenzuron, triflumuron, novaluron, noviflumuron, bistrifluoron, fluazuron, flucycloxuron, flufenoxuron, hexaflumuron, lufenuron, chromafenozide, tebufenozide, halofenozide, methoxyfenozide, diofenolan, cyromazine, pyriproxyfen, buprofezin, methoprene, hydroprene, kinoprene, triazamate, endosulfan, chlorfenson, chlorobenzilate, dicofol, bromopropylate, acetoprole, flpronil, ethiprole, pyrethrin, rotenone, nicotine sulphate, BT (*Bacillus Thuringiensis*) agent, spinosad, abamectin, acequinocyl, amidoflumet, amitraz, etoxazole, chinomethionat, clofentezine, fenbutatin oxide, dienochlor, cyhexatin, spirodiclofen, spiromesifen, tetradifon, tebufenpyrad, binapacryl, bifenazate, pyridaben, pyrimidifen, fenazaquin, fenothiocarb, fenpyroximate, fluacrypyrim, fluazinam, flufenzin, hexythiazox, propargite, benzomate, polynactin complex, milbemectin, lufenuron, mecarbam, methiocarb, mevinphos, halfenprox, azadirachtin, diafenthiuron, indoxacarb, emamectin benzoate, potassium oleate, sodium oleate, chlorfenapyr, tolfenpyrad, pymetrozine, fenoxycarb, hydramethylnon, hydroxy propyl starch, pyridalyl, flufenerim, flubendiamide, flonicamid, metaflumizole, lepimectin, TPIC, albendazole, oxibendazole, oxfendazole, trichlamide, fensulfothion, fenbendazole, levamisole hydrochloride, morantel tartrate, dazomet, metam-sodium, triadimefon, hexaconazole, propiconazole, ipconazole, prochloraz, triflumizole, tebuconazole, epoxiconazole, difenoconazole, flusilazole, triadimenol, cyproconazole, metconazole, fluquinconazole, bitertanol, tetraconazole, triticonazole, flutriafol, penconazole, diniconazole, fenbuconazole, bromuconazole, imibenconazole, simeconazole, myclobutanil, hymexazole, imazalil, furametpyr, thifluzamide, etridiazole, oxpoconazole, oxpoconazole fumarate, pefurazoate, prothioconazole, pyrifenox, fenarimol, nuarimol, bupirimate, mepanipyrim, cyprodinil, pyrimethanil, metalaxyl, mefenoxam, oxadixyl, benalaxyl, thiophanate, thiophanate-methyl, benomyl, carbendazim, fuberidazole, thiabendazole, manzeb, propineb, zineb, metiram, maneb, ziram, thiuram, chlorothalonil, ethaboxam, oxycarboxin, carboxin, flutolanil, silthiofam, mepronil, dimethomorph, fenpropidin, fenpropimorph, spiroxamine, tridemorph, dodemorph, flumorph, azoxystrobin, kresoxim-methyl, metominostrobin, orysastrobin, fluoxastrobin, trifloxystrobin, dimoxystrobin, pyraclostrobin, picoxystrobin, iprodione, procymidone, vinclozolin, chlozolinate, flusulfamide, dazomet, methyl isothiocyanate, chloropicrin, methasulfocarb, hydroxyisoxazole, potassium hydroxyisoxazole, echlomezol, D-D, carbam, basic copper chloride, basic copper sulfate, copper nonylphenolsulfonate, oxine copper, DBEDC, anhydrous copper sulfate, copper sulfate pentahydrate, cupric hydroxide, inorganic sulfur, wettable sulfur, lime sulfur, zinc sulfate, fentin, sodium hydrogen carbonate, potassium hydrogen carbonate, sodium hypochlorite, silver, edifenphos, tolclofos-methyl, fosetyl, iprobenfos, dinocap, pyrazophos, carpropamid, fthalide, tricyclazole, pyroquilon, diclocymet, fenoxanil, kasugamycin, validamycin, polyoxins, blasticiden S, oxytetracycline, mildiomycin, streptomycin, rape seed oil, machine oil, benthiavalicarbisopropyl, iprovalicarb, propamocarb, diethofencarb, fluoroimide, fludioxanil, fenpiclonil, quinoxyfen, oxolinic acid, chlorothalonil, captan, folpet, probenazole, acibenzolar-S-methyl, tiadinil, cyflufenamid, fenhexamid, diflumetorim, metrafenone, picobenzamide, proquinazid, famoxadone, cyazofamid, fenamidone, zoxamide, boscalid, cymoxanil, dithianon, fluazinam, dichlofluanide, triforine, isoprothiolane, ferimzone, diclomezine, tecloftalam, pencycuron, chinomethionat, iminoctadine acetate, iminoctadine albesilate, ambam, polycarbamate, thiadiazine, chloroneb, nickel dimethyldithiocarbamate, guazatine, dodecylguanidine-acetate, quintozene, tolylfluanid, anilazine, nitrothalisopropyl, fenitropan, dimethirimol, benthiazole, harpin protein, flumetover, mandipropamide and penthiopyrad.

Polynucleotides

As used herein, the term “DNA”, “DNA molecule”, “DNA polynucleotide molecule” refers to a single-stranded DNA (ssDNA) or double-stranded DNA (dsDNA) molecule of genomic or synthetic origin, such as, a polymer of deoxyribonucleotide bases or a DNA polynucleotide molecule. As used herein, the term “DNA sequence”, “DNA nucleotide sequence” or “DNA polynucleotide sequence” refers to the nucleotide sequence of a DNA molecule. As used herein, the term “RNA”, “RNA molecule”, “RNA polynucleotide molecule” refers to a single-stranded RNA (ssRNA) or double-stranded RNA (dsRNA) molecule of genomic or synthetic origin, such as, a polymer of ribonucleotide bases that comprise single or double stranded regions. Unless otherwise stated, nucleotide sequences in the text of this specification are given, when read from left to right, in the 5' to 3' direction. The nomenclature used herein is that required by Title 37 of the United States Code of Federal Regulations §1.822 and set forth in the tables in WIPO Standard ST.25 (1998), Appendix 2, Tables 1 and 3.

As used herein, “polynucleotide” refers to a DNA or RNA molecule containing multiple nucleotides and generally refers both to “oligonucleotides” (a polynucleotide molecule of typically 50 or fewer nucleotides in length) and polynucleotides of 51 or more nucleotides. Embodiments include compositions including oligonucleotides having a length of 18-25 nucleotides (18-mers, 19-mers, 20-mers, 21-mers, 22-mers, 23-mers, 24-mers, or 25-mers), for example, oligonucleotides of Table 3 (SEQ ID NO:1382-2221) or fragments thereof or medium-length polynucleotides having a length of 26 or more nucleotides (polynucleotides of 26, 27, 28, 29, 30, 46, 32, 33, 34, 35, 36, 37, 38, 39, 40, 41, 42, 43, 44, 45, 46, 47, 48, 49, 50, 51, 52, 53, 54, 55, 56, 57, 58, 59, 60, about 65, about 70, about 75, about 80, about 85, about 90, about 95, about 100, about 110, about 120, about 130, about 140, about 150, about 160, about 170, about 180, about 190, about 200, about 210, about 220, about 230, about 240, about 250, about 260, about 270, about 280, about 290, or about 300 nucleotides), for example, oligonucleotides of Table 2 (SEQ ID NO:72-1381) or fragments thereof or long polynucleotides having a length greater than about 300 nucleotides (for example, polynucleotides of between about 300 to about 400 nucleotides, between about 400 to about 500 nucleotides, between about 500 to about 600 nucleotides, between about 600 to about 700 nucleotides, between about 700 to about 800 nucleotides, between about 800 to about 900 nucleotides, between about 900 to about 1000 nucleotides, between about 300 to about 500 nucleotides, between about 300 to about 600 nucleotides, between about 300 to about 700 nucleotides, between about 300 to about 800 nucleotides, between about 300 to about 900 nucleotides, or about 1000 nucleotides in length, or even greater than about 1000 nucleotides in length, for example up to the entire length of a target gene including coding or non-coding or both coding and non-coding portions of the target gene), for example, polynucleotides of Table 1 (SEQ ID NO:1-71), wherein the selected polynucleotides or fragments thereof homologous or complementary to SEQ ID NO:1-71 suppresses, represses or otherwise delay the expression of the target PPG oxidase gene. A target gene comprises any polynucleotide molecule in a plant cell or fragment thereof for which the modulation of the expression of the target gene is provided by the methods and compositions. Where a polynucleotide is double-stranded, its length can be similarly described in terms of base pairs. Oligonucleotides and polynucleotides can be made that are essentially identical or essentially complementary to adjacent genetic elements of a gene, for example, spanning the junction region of an intron and exon, the junction region of a promoter and a transcribed region, the junction region of a 5' leader and a coding sequence, the junction of a 3' untranslated region and a coding sequence.

Polynucleotide compositions used in the various embodiments include compositions including oligonucleotides or polynucleotides or a mixture of both, including RNA or DNA or RNA/DNA hybrids or chemically modified oligonucleotides or polynucleotides or a mixture thereof. In some embodiments, the polynucleotide may be a combination of ribonucleotides and deoxyribonucleotides, for example, synthetic polynucleotides consisting mainly of ribonucleotides but with one or more terminal deoxyribonucleotides or synthetic polynucleotides consisting mainly of deoxyribonucleotides but with one or more terminal dideoxyribonucleotides. In some embodiments, the polynucleotide includes non-canonical nucleotides such as inosine, thiouridine, or pseudouridine. In some embodiments, the polynucleotide includes chemically modified nucleotides. Examples of chemically modified oligonucleotides or polynucleotides are well known in the art; see, for example, US Patent Publication 20110171287, US Patent Publication 20110171176, and US Patent Publication 20110152353, US Patent Publication, 20110152346, US Patent Publication 20110160082, herein incorporated by reference. For example, including but not limited to the naturally occurring phosphodiester backbone of an oligonucleotide or polynucleotide can be partially or completely modified with phosphorothioate, phosphorodithioate, or methylphosphonate internucleotide linkage modifications, modified nucleoside bases or modified sugars can be used in oligonucleotide or polynucleotide synthesis, and oligonucleotides or polynucleotides can be labeled with a fluorescent moiety (for example, fluorescein or rhodamine) or other label (for example, biotin).

The polynucleotides can be single- or double-stranded RNA or single- or double-stranded DNA or double-stranded DNA/RNA hybrids or modified analogues thereof, and can be of oligonucleotide lengths or longer. In more specific embodiments the polynucleotides that provide single-stranded RNA in the plant cell are selected from the group consisting of (a) a single-stranded RNA molecule (ssRNA), (b) a single-stranded RNA molecule that self-hybridizes to form a double-stranded RNA molecule, (c) a double-stranded RNA molecule (dsRNA), (d) a single-stranded DNA molecule (ssDNA), (e) a single-stranded DNA molecule that self-hybridizes to form a double-stranded DNA molecule, and (f) a single-stranded DNA molecule including a modified Pol III gene that is transcribed to an RNA molecule, (g) a double-stranded DNA molecule (dsDNA), (h) a double-stranded DNA molecule including a modified Pol III gene that is transcribed to an RNA molecule, (i) a double-stranded, hybridized RNA/DNA molecule, or combinations thereof. In some embodiments these polynucleotides include chemically modified nucleotides or non-canonical nucleotides. In some embodiments, the oligonucleotides may be blunt-ended or may comprise a 3' overhang of from 1-5 nucleotides of at least one or both of the strands. Other configurations of the oligonucleotide are known in the field and are contemplated herein. In embodiments of the method the polynucleotides include double-stranded DNA formed by intramolecular hybridization, double-stranded DNA formed by intermolecular hybridization, double-stranded RNA formed by intramolecular hybridization, or double-stranded RNA formed by intermolecular hybridization. In one embodiment the polynucleotides include single-stranded DNA or single-stranded RNA that self-hybridizes to form a hairpin structure having an at least partially double-stranded structure including at least one segment that will hybridize to RNA transcribed from the gene targeted for suppression. Not intending to be bound by any mechanism, it is believed that such polynucleotides are or will produce single-stranded RNA with at least one segment that will hybridize to RNA transcribed from the gene targeted for suppression. In certain other embodiments the polynucleotides further includes a promoter, generally a promoter functional in a plant, for example, a pol II promoter, a pol III promoter, a pol IV promoter, or a pol V promoter.

The term "gene" refers to components that comprise chromosomal DNA, plasmid DNA, cDNA, intron and exon DNA, artificial DNA polynucleotide, or other DNA that encodes a peptide, polypeptide, protein, or RNA transcript molecule, and the genetic elements flanking the coding sequence that are involved in the regulation of expression, such as, promoter regions, 5' leader regions, 3' untranslated region that may exist as native genes or transgenes in a plant genome. The gene or a fragment thereof is isolated and subjected to polynucleotide sequencing methods that determines the order of the nucleotides that comprise the gene. Any of the components of the gene are potential targets for a trigger oligonucleotide and polynucleotides.

The trigger polynucleotide molecules are designed to modulate expression by inducing regulation or suppression of an endogenous PPG oxidase gene in a plant and are designed to have a nucleotide sequence essentially identical or essentially complementary to the nucleotide sequence of an endogenous PPG oxidase gene of a plant or to the sequence of RNA transcribed from an endogenous PPG oxidase gene of a plant, including a transgene in a plant that provides for a herbicide resistant PPG oxidase enzyme, which can be coding sequence or non-coding sequence. Effective molecules that modulate expression are referred to as "a trigger molecule, or trigger polynucleotides". By "essentially identical" or "essentially complementary" is meant that the trigger polynucleotides (or at least one strand of a double-stranded polynucleotide or portion thereof, or a portion of a single strand polynucleotide) are designed to hybridize to the endogenous gene noncoding sequence or to RNA transcribed (known as messenger RNA or an RNA transcript) from the endogenous gene to effect regulation or suppression of expression of the endogenous gene. Trigger molecules are identified by "tiling" the gene targets with partially overlapping probes or non-overlapping probes of antisense or sense polynucleotides that are essentially identical or essentially complementary to the nucleotide sequence of an endogenous gene. Multiple target sequences can be aligned and sequence regions with homology in common, according to the methods, are identified as potential trigger molecules for the multiple targets. Multiple trigger molecules of various lengths, for example 18-25 nucleotides, 26-50 nucleotides, 51-100 nucleotides, 101-200 nucleotides, 201-300 nucleotides or more can be pooled into a few treatments in order to investigate polynucleotide molecules that cover a portion of a gene sequence (for example, a portion of a coding versus a portion of a noncoding region, or a 5' versus a 3' portion of a gene) or an entire gene sequence including coding and noncoding regions of a target gene. Polynucleotide molecules of the pooled trigger molecules can be divided into smaller pools or single molecules inorder to identify trigger molecules that provide the desired effect.

The target gene RNA and DNA polynucleotide molecules (Table 1, SEQ ID NO:1-71) are sequenced by any number of available methods and equipment. Some of the sequencing technologies are available commercially, such as the sequencing-by-hybridization platform from Affymetrix Inc. (Sunnyvale, Calif.) and the sequencing-by-synthesis platforms from 454 Life Sciences (Bradford, Conn.), Illumina/Solexa (Hayward, Calif.) and Helicos Biosciences (Cambridge, Mass.), and the sequencing-by-ligation platform from Applied Biosystems (Foster City, Calif.), as described below. In addition to the single molecule sequencing performed using sequencing-by-synthesis of Helicos Biosciences, other single molecule sequencing technologies are encompassed by the method and include the SMRT™. technology of Pacific Biosciences, the Ion Torrent™ technology, and nanopore sequencing being developed for example, by Oxford Nanopore Technologies. A PPG oxidase target gene comprising DNA or RNA can be isolated using primers or probes essentially complementary or essentially homologous to SEQ ID NO:1-71 or a fragment thereof. A polymerase chain reaction (PCR) gene fragment can be produced using primers essentially complementary or essentially homologous to SEQ ID NO:1-71 or a fragment thereof that is useful to isolate a PPG oxidase gene from a plant genome. SEQ ID NO: 1-71 or fragments thereof can be used in various sequence capture technologies to isolate additional target gene sequences, for example, including but not limited to Roche NimbleGen® (Madison, Wis.) and Streptavdin-coupled Dynabeads® (Life Technologies, Grand Island, N.Y.) and US20110015284, herein incorporated by reference in its entirety.

Embodiments of functional single-stranded polynucleotides have sequence complementarity that need not be 100 percent, but is at least sufficient to permit hybridization to RNA transcribed from the target gene or DNA of the target gene to form a duplex to permit a gene silencing mechanism. Thus, in embodiments, a polynucleotide fragment is designed to be essentially identical to, or essentially complementary to, a sequence of 18 or more contiguous nucleotides in either the target PPG oxidase gene sequence or messenger RNA transcribed from the target gene. By "essentially identical" is meant having 100 percent sequence identity or at least about 83, 84, 85, 86, 87, 88, 89, 90, 91, 92, 93, 94, 95, 96, 97, 98, or 99 percent sequence identity when compared to the sequence of 18 or more contiguous nucleotides in either the target gene or RNA transcribed from the target gene; by "essentially complementary" is meant having 100 percent sequence complementarity or at least about 83, 84, 85, 86, 87, 88, 89, 90, 91, 92, 93, 94, 95, 96, 97, 98, or 99 percent sequence complementarity when compared to the sequence of 18 or more contiguous nucleotides in either the target gene or RNA transcribed from the target gene. In some embodiments, polynucleotide molecules are designed to have 100 percent sequence identity with or complementarity to one allele or one family member of a given target gene (coding or noncoding sequence of a gene); in other embodiments the polynucleotide molecules are designed to have 100 percent sequence identity with or complementarity to multiple alleles or family members of a given target gene. The trigger polynucleotide sequences in the sequence listing SEQ ID NO: 1-2221 or table 1, 2 or 3 maybe complementary or homologous to a portion of the PPG oxidase target gene sequence.

In certain embodiments, the polynucleotides used in the compositions that are essentially identical or essentially complementary to the target gene or transcript will comprise the predominant nucleic acid in the composition. Thus in certain embodiments, the polynucleotides that are essentially identical or essentially complementary to the target gene or transcript will comprise at least about 50%, 75%, 95%, 98% or 100% of the nucleic acids provided in the composition by either mass or molar concentration. However, in certain embodiments, the polynucleotides that are essentially identical or essentially complementary to the target gene or transcript can comprise at least about 1% to about 50%, about 10% to about 50%, about 20% to about 50%, or about 30% to about 50% of the nucleic acids provided in the composition by either mass or molar concentration. Also provided are compositions where the polynucleotides that are essentially identical or essentially complementary to the target gene or transcript can comprise at least about 1% to 100%, about 10% to 100%, about 20% to about 100%, about 30% to about 50%, or about 50% to a 100% of the nucleic acids provided in the composition by either mass or molar concentration.

"Identity" refers to the degree of similarity between two polynucleic acid or protein sequences. An alignment of the two sequences is performed by a suitable computer program. A widely used and accepted computer program for performing sequence alignments is CLUSTALW v1.6 (Thompson, et al. Nucl. Acids Res., 22: 4673-4680, 1994). The number of matching bases or amino acids is divided by the total number of bases or amino acids, and multiplied by 100 to obtain a percent identity. For example, if two 580 base pair sequences had 145 matched bases, they would be 25 percent identical. If the two compared sequences are of different lengths, the number of matches is divided by the shorter of the two lengths. For example, if there are 100 matched amino acids between a 200 and a 400 amino acid protein, they are 50 percent identical with respect to the shorter sequence. If the shorter sequence is less than 150 bases or 50 amino acids in length, the number of matches are divided by 150 (for nucleic acid bases) or 50 (for amino acids), and multiplied by 100 to obtain a percent identity.

Trigger molecules for specific gene family members can be identified from coding and/or non-coding sequences of gene families of a plant or multiple plants, by aligning and selecting 200-300 polynucleotide fragments from the least homologous regions amongst the aligned sequences and evaluated using topically applied polynucleotides (as sense or antisense ssDNA or ssRNA, dsRNA, or dsDNA) to determine their relative effectiveness in inducing the herbicidal phenotype. The effective segments are further subdivided into 50-60 polynucleotide fragments, prioritized by least homology, and reevaluated using topically applied polynucleotides. The effective 50-60 polynucleotide fragments are subdivided into 19-30 polynucleotide fragments, prioritized by least homology, and again evaluated for induction of the yield/quality phenotype. Once relative effectiveness is determined, the fragments are utilized singly, or again evaluated in combination with one or more other fragments to determine the trigger composition or mixture of trigger polynucleotides for providing the yield/quality phenotype.

Trigger molecules for broad activity can be identified from coding and/or non-coding sequences of gene families of a plant or multiple plants, by aligning and selecting 200-300 polynucleotide fragments from the most homologous regions amongst the aligned sequences and evaluated using topically applied polynucleotides (as sense or anti-sense ssDNA or ssRNA, dsRNA, or dsDNA) to determine their relative effectiveness in inducing the yield/quality phenotype. The effective segments are subdivided into 50-60 polynucleotide fragments, prioritized by most homology, and reevaluated using topically applied polynucleotides. The effective 50-60 polynucleotide fragments are subdivided into 19-30 polynucleotide fragments, prioritized by most homology, and again evaluated for induction of the yield/quality phenotype. Once relative effectiveness is determined, the fragments may be utilized singly, or in combination with one or more other fragments to determine the trigger composition or mixture of trigger polynucleotides for providing the yield/quality phenotype.

Methods of making polynucleotides are well known in the art. Chemical synthesis, in vivo synthesis and in vitro synthesis methods and compositions are known in the art and include various viral elements, microbial cells, modified polymerases, and modified nucleotides. Commercial preparation of oligonucleotides often provides two deoxyribonucleotides on the 3' end of the sense strand. Long polynucleotide molecules can be synthesized from commercially available kits, for example, kits from Applied Biosystems/Ambion (Austin, Tex.) have DNA ligated on the 5' end in a microbial expression cassette that includes a bacterial T7 polymerase promoter that makes RNA strands that can be assembled into a dsRNA and kits provided by various manufacturers that include T7 RiboMax Express (Promega, Madison, Wis.), AmpliScribe T7-Flash (Epicentre, Madison, Wis.), and TranscriptAid T7 High Yield (Fermentas, Glen Burnie, Md.). dsRNA molecules can be produced from microbial expression cassettes in bacterial cells (Ongvarrasopone et al. ScienceAsia 33:35-39; Yin, Appl. Microbiol. Biotechnol 84:323-333, 2009; Liu et al., BMC Biotechnology 10:85, 2010) that have regulated or deficient RNase III enzyme activity or the use of various viral vectors to produce sufficient quantities of dsRNA. PPG oxidase gene fragments are inserted into the microbial expression cassettes in a position in which the fragments are express to produce ssRNA or dsRNA useful in the methods described herein to regulate expression on a target PPG oxidase gene. Long polynucleotide molecules can also be assembled from multiple RNA or DNA fragments. In some embodiments design parameters such as Reynolds score (Reynolds et al. Nature Biotechnology 22, 326-330 (2004), Tuschl rules (Pei and Tuschl, Nature Methods 3(9): 670-676, 2006), i-score (Nucleic Acids Res 35: e123, 2007), i-Score Designer tool and associated algorithms (Nucleic Acids Res 32: 936-948, 2004. Biochem Biophys Res Commun 316: 1050-1058, 2004, Nucleic Acids Res 32: 893-901, 2004, Cell Cycle 3: 790-5, 2004, Nat Biotechnol 23: 995-1001, 2005, Nucleic Acids Res 35: e27, 2007, BMC Bioinformatics 7: 520, 2006, Nucleic Acids Res 35: e123, 2007, Nat Biotechnol 22: 326-330, 2004) are known in the art and may be used in selecting polynucleotide sequences effective in gene silencing. In some embodiments the sequence of a polynucleotide is screened against the genomic DNA of the intended plant to minimize unintentional silencing of other genes.

The trigger polynucleotide and oligonucleotide molecule compositions are useful in compositions, such as liquids that comprise these polynucleotide molecules, at low concentrations, alone or in combination with other components, for example one or more herbicide molecules, either in the same solution or in separately applied liquids that also provide a transfer agent. While there is no upper limit on the concentrations and dosages of polynucleotide molecules that can useful in the methods, lower effective concentrations and dosages will generally be sought for efficiency. The concentrations can be adjusted in consideration of the volume of spray or treatment applied to plant leaves or other plant part surfaces, such as flower petals, stems, tubers, fruit, anthers, pollen, or seed. In one embodiment, a useful treatment for herbaceous plants using 25-mer oligonucleotide molecules is about 1 nanomole (nmol) of oligonucleotide molecules per plant, for example, from about 0.05 to 1 nmol per plant. Other embodiments for herbaceous plants include useful ranges of about 0.05 to about 100 nmol, or about 0.1 to about 20 nmol, or about 1 nmol to about 10 nmol of polynucleotides per plant. Very large plants, trees, or vines may require correspondingly larger amounts of polynucleotides. When using long dsRNA molecules that can be processed into multiple oligonucleotides, lower concentrations can be used. To illustrate certain embodiments, the factor 1×, when applied to oligonucleotide molecules is arbitrarily used to denote a treatment of 0.8 nmol of polynucleotide molecule per plant; 10×, 8 nmol of polynucleotide molecule per plant; and 100×, 80 nmol of polynucleotide molecule per plant.

The polynucleotide compositions are useful in compositions, such as liquids that comprise polynucleotide molecules, alone or in combination with other components either in the same liquid or in separately applied liquids that provide a transfer agent. As used herein, a transfer agent is an agent that, when combined with a polynucleotide in a composition that is topically applied to a target plant surface, enables the polynucleotide to enter a plant cell. In certain embodiments, a transfer agent is an agent that conditions the surface of plant tissue, e. g., leaves, stems, roots, flowers, or fruits, to permeation by the polynucleotide molecules into plant cells. The transfer of polynucleotides into plant cells can be facilitated by the prior or contemporaneous application of a polynucleotide-transferring agent to the plant tissue. In some embodiments the transferring agent is applied subsequent to the application of the polynucleotide composition. The polynucleotide transfer agent enables a pathway for polynucleotides through cuticle wax barriers, stomata and/or cell wall or membrane barriers into plant cells. Suitable transfer agents to facilitate transfer of the polynucleotide into a plant cell include agents that increase permeability of the exterior of the plant or that increase permeability of plant cells to oligonucleotides or polynucleotides. Such agents to facilitate transfer of the composition into a plant cell include a chemical agent, or a physical agent, or combinations thereof. Chemical agents for conditioning or transfer include (a) surfactants, (b) an organic solvent or an aqueous solution or aqueous mixtures of organic solvents, (c) oxidizing agents, (d) acids, (e) bases, (f) oils, (g) enzymes, or combinations thereof. Embodiments of the method can optionally include an incubation step, a neutralization step (e.g., to neutralize an acid, base, or oxidizing agent, or to inactivate an enzyme), a rinsing step, or combinations thereof. Embodiments of agents or treatments for conditioning of a plant to permeation by polynucleotides include emulsions, reverse emulsions, liposomes, and other micellar-like compositions. Embodiments of agents or treatments for conditioning of a plant to permeation by polynucleotides include counter-ions or other molecules that are known to associate with nucleic acid molecules, e. g., inorganic ammonium ions, alkyl ammonium ions, lithium ions, polyamines such as spermine, spermidine, or putrescine, and other cations. Organic solvents useful in conditioning a plant to permeation by polynucleotides include DMSO, DMF, pyridine, N-pyrrolidine, hexamethylphosphoramide, acetonitrile, dioxane, polypropylene glycol, other solvents miscible with water or that will dissolve phosphonucleotides in non-aqueous systems (such as is used in synthetic reactions). Naturally derived or synthetic oils with or without surfactants or emulsifiers can be used, e. g., plant-sourced oils, crop oils (such as those listed in the $9^{th}$ Compendium of Herbicide Adjuvants, publicly available on the worldwide web (internet) at herbicide.adjuvants.com can be used, e. g., paraffinic oils, polyol fatty acid esters, or oils with short-chain molecules modified with amides or polyamines such as polyethyleneimine or N-pyrrolidine. Transfer agents include, but are not limited to, organosilicone preparations.

Ligands can be tethered to a polynucleotide, for example a dsRNA, ssRNA, dsDNA or ssDNA. Ligands in general can include modifiers, e.g., for enhancing uptake; diagnostic compounds or reporter groups e.g., for monitoring distribution; cross-linking agents; nuclease-resistance conferring moieties; and natural or unusual nucleobases. General examples include lipophiles, lipids (e.g., cholesterol, a bile acid, or a fatty acid (e.g., lithocholic-oleyl, lauroyl, docosnyl, stearoyl, palmitoyl, myristoyl oleoyl, linoleoyl), steroids (e.g., uvaol, hecigenin, diosgenin), terpenes (e.g., triterpenes, e.g., sarsasapogenin, Friedelin, epifriedelanol derivatized lithocholic acid), vitamins (e.g., folic acid, vitamin A, biotin, pyridoxal), carbohydrates, proteins, protein binding agents, integrin targeting molecules, polycationics, peptides, polyamines, and peptide mimics. The ligand may also be a recombinant or synthetic molecule, such as a synthetic polymer, e.g., polyethylene glycol (PEG), PEG-40K, PEG-20K and PEG-5K. Other examples of ligands include lipophilic molecules, e.g, cholesterol, cholic acid, adamantane acetic acid, 1-pyrene butyric acid, dihydrotestosterone, glycerol (e.g., esters and ethers thereof, e.g., C.sub.10, C.sub.11, C.sub.12, C.sub.13, C.sub.14, C.sub.15, C.sub.16, C.sub.17, C.sub.18, C.sub.19, or C.sub.20 alkyl; e.g., lauroyl, docosnyl, stearoyl, oleoyl, linoleoyl 1,3-bis-O(hexadecyl)glycerol, 1,3-bis-O(octaadecyl)glycerol), geranyloxyhexyl group, hexadecylglycerol, borneol, menthol, 1,3-propanediol, heptadecyl group, palmitic acid, myristic acid, O3-(oleoyl)lithocholic acid, O3-(oleoyl)cholenic acid, dodecanoyl, lithocholyl, 5.beta.-cholanyl, N,N-distearyl-lithocholamide, 1,2-di-O-stearoylglyceride, dimethoxytrityl, or phenoxazine) and PEG (e.g., PEG-5K, PEG-20K, PEG-40K). Preferred lipophilic moieties include lipid, cholesterols, oleyl, retinyl, or cholesteryl residues.

Conjugating a ligand to a dsRNA can enhance its cellular absorption, lipophilic compounds that have been conjugated to oligonucleotides include 1-pyrene butyric acid, 1,3-bis-O-(hexadecyl)glycerol, and menthol. One example of a ligand for receptor-mediated endocytosis is folic acid. Folic acid enters the cell by folate-receptor-radiated endocytosis. dsRNA compounds bearing folic acid would be efficiently transported into the cell via the folate-receptor-mediated endocytosis. Other ligands that have been conjugated to oligonucleotides include polyethylene glycols, carbohydrate clusters, cross-linking agents, porphyrin conjugates, delivery peptides and lipids such as cholesterol. In certain instances, conjugation of a cationic ligand to oligonucleotides results in improved resistance to nucleases. Representative examples of cationic ligands are propylammonium and dimethylpropylammonium. Interestingly, antisense oligonucleotides were reported to retain their high binding affinity to mRNA when the cationic ligand was dispersed, throughout the oligonucleotide. See M. Manoharan Antisense & Nucleic Acid Drug Development 2002, 12, 103 and references therein.

A biologic delivery can be accomplished by a variety of methods including, without limitation, (1) loading liposomes with a dsRNA acid molecule provided herein and (2) complexing a dsRNA molecule with lipids or liposomes to form nucleic acid-lipid or nucleic acid-liposome complexes. The liposome can be composed of cationic and neutral lipids commonly used to transfect cells in vitro. Cationic lipids can complex (e.g., charge-associate) with negatively charged, nucleic acids to form liposomes. Examples of cationic liposomes include, without limitation, LIPOFECTIN® (Invitrogen/Life Technologies, Carlsbad, Calif., a 1:1 (w/w) liposome formulation of the cationic lipid N-[1-(2,3-dioleyloxy) propyl]-n,n,n-trimethylammonium chloride (DOTMA) and dioleoyl phophotidylethanolamine (DOPE)), LIPOFECTAMINE® (Invitrogen/Life Technologies, Carlsbad, Calif., a proprietary cationic liposome formulation), LIPOFECTACE® (Invitrogen/Life Technologies, Carlsbad, Calif., a liposome formulation of dimethyldioctadecylammonium bromide (DDAB) and DOPE), and DOTAP. Procedures for forming liposomes are well known in the art. Liposome compositions can be formed, for example, from phosphatidylcholine, dimyristoyl phosphatidylcholine, dipalmitoyl phosphatidylcholine, dimyristoyl phosphatidyl glycerol, dioleoyl phosphatidylethanolamine or liposomes comprising dihydrosphingomyelin (DHSM). Numerous lipophilic agents are commercially available, including LIPOFECTIN® (Invitrogen/Life Technologies, Carlsbad, Calif.) and EFFECTENE™ (Qiagen, Valencia, Calif., a proprietary non-liposomal lipid formulation). In addition, systemic delivery methods can be optimized using commercially available cationic lipids such as DDAB or DOTAP, each of which can be mixed with a neutral lipid such as DOPE or cholesterol. In some cases, liposomes such as those described by Templeton et al. Nature Biotechnology, 15:647-652 (1997) can be used. In other embodiments, polycations such as polyethyleneimine can be used to achieve delivery in vivo and ex vivo (Boletta et al., J. Am Soc. Nephrol. 7:1728, 1996). Additional information regarding the use of liposomes to deliver nucleic acids can be found in U.S. Pat. No. 6,271,359, PCT Publication WO 96/40964 and Morrissey, D. et al., 2005, Nature Biotechnol. 23(8):1002-7.

In certain embodiments, an organosilicone preparation that is commercially available as Silwet® L-77 surfactant having CAS Number 27306-78-1 and EPA Number: CAL.REG.NO. 5905-50073-AA, and currently available from Momentive Performance Materials, Albany, N.Y. can be used to prepare a polynucleotide composition. In certain embodiments where a Silwet L-77 organosilicone preparation is used as a pre-spray treatment of plant leaves or other plant surfaces, freshly made concentrations in the range of about 0.015 to about 2 percent by weight (wt percent) (e. g., about 0.01, 0.015, 0.02, 0.025, 0.03, 0.035, 0.04, 0.045, 0.05, 0.055, 0.06, 0.065, 0.07, 0.075, 0.08, 0.085, 0.09, 0.095, 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2.0, 2.1, 2.2, 2.3, 2.5 wt percent) are efficacious in preparing a leaf or other plant surface for transfer of polynucleotide molecules into plant cells from a topical application on the surface. In certain embodiments of the methods and compositions provided herein, a composition that comprises a polynucleotide molecule and an organosilicone preparation comprising Silwet L-77 in the range of about 0.015 to about 2 percent by weight (wt percent) (e. g., about 0.01, 0.015, 0.02, 0.025, 0.03, 0.035, 0.04, 0.045, 0.05, 0.055, 0.06, 0.065, 0.07, 0.075, 0.08, 0.085, 0.09, 0.095, 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2.0, 2.1, 2.2, 2.3, 2.5 wt percent) is used or provided.

In certain embodiments, any of the commercially available organosilicone preparations provided such as the following Breakthru S 321, Breakthru S 200 Cat#67674-67-3, Breakthru OE 441 Cat#68937-55-3, Breakthru S 278 Cat #27306-78-1, Breakthru S 243, Breakthru S 233 Cat#134180-76-0, available from manufacturer Evonik Goldschmidt (Germany), Silwet® HS 429, Silwet® HS 312, Silwet® HS 508, Silwet® HS 604 (Momentive Performance Materials, Albany, N.Y.) can be used as transfer agents in a polynucleotide composition. In certain embodiments where an organosilicone preparation is used as a pre-spray treatment of plant leaves or other surfaces, freshly made concentrations in the range of about 0.015 to about 2 percent by weight (wt percent) (e. g., about 0.01, 0.015, 0.02, 0.025, 0.03, 0.035, 0.04, 0.045, 0.05, 0.055, 0.06, 0.065, 0.07, 0.075, 0.08, 0.085, 0.09, 0.095, 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2.0, 2.1, 2.2, 2.3, 2.5 wt percent) are efficacious in preparing a leaf or other plant surface for transfer of polynucleotide molecules into plant cells from a topical application on the surface. In certain embodiments of the methods and compositions provided herein, a composition that comprises a polynucleotide molecule and an organosilicone preparation in the range of about 0.015 to about 2 percent by weight (wt percent) (e. g., about 0.01, 0.015, 0.02, 0.025, 0.03, 0.035, 0.04, 0.045, 0.05, 0.055, 0.06, 0.065, 0.07, 0.075, 0.08, 0.085, 0.09, 0.095, 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2.0, 2.1, 2.2, 2.3, 2.5 wt percent) is used or provided.

Organosilicone preparations used in the methods and compositions provided herein can comprise one or more effective organosilicone compounds. As used herein, the phrase “effective organosilicone compound” is used to describe any organosilicone compound that is found in an organosilicone preparation that enables a polynucleotide to enter a plant cell. In certain embodiments, an effective organosilicone compound can enable a polynucleotide to enter a plant cell in a manner permitting a polynucleotide mediated suppression of a target gene expression in the plant cell. In general, effective organosilicone compounds include, but are not limited to, compounds that can comprise: i) a trisiloxane head group that is covalently linked to, ii) an alkyl linker including, but not limited to, an n-propyl linker, that is covalently linked to, iii) a poly glycol chain, that is covalently linked to, iv) a terminal group. Trisiloxane head groups of such effective organosilicone compounds include, but are not limited to, heptamethyltrisiloxane. Alkyl linkers can include, but are not limited to, an n-propyl linker. Poly glycol chains include, but are not limited to, polyethylene glycol or polypropylene glycol. Poly glycol chains can comprise a mixture that provides an average chain length “n” of about “7.5”. In certain embodiments, the average chain length “n” can vary from about 5 to about 14. Terminal groups can include, but are not limited to, alkyl groups such as a methyl group. Effective organosilicone compounds are believed to include, but are not limited to, trisiloxane ethoxylate surfactants or polyalkylene oxide modified heptamethyl trisiloxane.

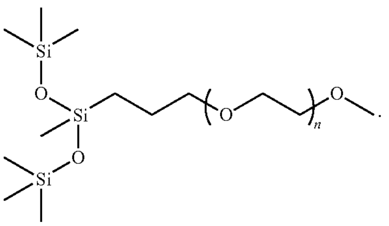

(Compound I: polyalkyleneoxide heptamethyltrisiloxane, average n = 7.5)

In certain embodiments, an organosilicone preparation that comprises an organosilicone compound comprising a trisiloxane head group is used in the methods and compositions provided herein. In certain embodiments, an organosilicone preparation that comprises an organosilicone compound comprising a heptamethyltrisiloxane head group is used in the methods and compositions provided herein. In certain embodiments, an organosilicone composition that comprises Compound I is used in the methods and compositions provided herein. In certain embodiments, an organosilicone composition that comprises Compound I is used in the methods and compositions provided herein. In certain embodiments of the methods and compositions provided herein, a composition that comprises a polynucleotide molecule and one or more effective organosilicone compound in the range of about 0.015 to about 2 percent by weight (wt percent) (e.g., about 0.01, 0.015, 0.02, 0.025, 0.03, 0.035, 0.04, 0.045, 0.05, 0.055, 0.06, 0.065, 0.07, 0.075, 0.08, 0.085, 0.09, 0.095, 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2.0, 2.1, 2.2, 2.3, 2.5 wt percent) is used or provided.

Compositions include but are not limited components that are one or more polynucleotides essentially identical to, or essentially complementary to a PPG oxidase gene sequence (promoter, intron, exon, 5' untranslated region, 3' untranslated region), a transfer agent that provides for the polynucleotide to enter a plant cell, a herbicide that complements the action of the polynucleotide, one or more additional herbicides that further enhance the herbicide activity of the composition or provide an additional mode of action different from the complementing herbicide, various salts and stabilizing agents that enhance the utility of the composition as an admixture of the components of the composition.

The methods include one or more applications of a polynucleotide composition and one or more applications of a permeability-enhancing agent for conditioning of a plant to permeation by polynucleotides. When the agent for conditioning to permeation is an organosilicone composition or compound contained therein, embodiments of the polynucleotide molecules are double-stranded RNA oligonucleotides, single-stranded RNA oligonucleotides, double-stranded RNA polynucleotides, single-stranded RNA polynucleotides, double-stranded DNA oligonucleotides, single-stranded DNA oligonucleotides, double-stranded DNA polynucleotides, single-stranded DNA polynucleotides, chemically modified RNA or DNA oligonucleotides or polynucleotides or mixtures thereof.

Compositions and methods are useful for modulating the expression of an endogenous PPG oxidase gene (for example U.S. Pat. Nos. 7,838,263; 6,084,155) or transgenic PPG oxidase gene (U.S. Pat. Nos. 7,842,856; 7,485,777; US Patent Publ. 20070050863) in a plant cell. In various embodiments, a PPG oxidase gene includes coding (protein-coding or translatable) sequence, non-coding (non-translatable) sequence, or both coding and non-coding sequence. Compositions can include polynucleotides and oligonucleotides designed to target multiple genes, or multiple segments of one or more genes. The target gene can include multiple consecutive segments of a target gene, multiple non-consecutive segments of a target gene, multiple alleles of a target gene, or multiple target genes from one or more species.

A method is provided for modulating expression of a PPG oxidase gene in a plant including (a) conditioning of a plant to permeation by polynucleotides and (b) treatment of the plant with the polynucleotide molecules, wherein the polynucleotide molecules include at least one segment of 18 or more contiguous nucleotides cloned from or otherwise identified from the target PPG oxidase gene in either anti-sense or sense orientation, whereby the polynucleotide molecules permeate the interior of the plant and induce modulation of the target gene. The conditioning and polynucleotide application can be performed separately or in a single step. When the conditioning and polynucleotide application are performed in separate steps, the conditioning can precede or can follow the polynucleotide application within minutes, hours, or days. In some embodiments more than one conditioning step or more than one polynucleotide molecule application can be performed on the same plant. In embodiments of the method, the segment can be cloned or identified from (a) coding (protein-encoding), (b) non-coding (promoter and other gene related molecules), or (c) both coding and non-coding parts of the target gene. Non-coding parts include DNA, such as promoter regions or the RNA transcribed by the DNA that provide RNA regulatory molecules, including but not limited to: introns, 5' or 3' untranslated regions, and microRNAs (miRNA), trans-acting siRNAs, natural anti-sense siRNAs, and other small RNAs with regulatory function or RNAs having structural or enzymatic function including but not limited to: ribozymes, ribosomal RNAs, t-RNAs, aptamers, and riboswitches.

All publications, patents and patent applications are herein incorporated by reference to the same extent as if each individual publication or patent application was specifically and individually indicated to be incorporated by reference.

The following examples are included to demonstrate examples of certain preferred embodiments. It should be appreciated by those of skill in the art that the techniques disclosed in the examples that follow represent approaches the inventors have found function well in the practice of the invention, and thus can be considered to constitute examples of preferred modes for its practice. However, those of skill in the art should, in light of the present disclosure, appreciate that many changes can be made in the specific embodiments that are disclosed and still obtain a like or similar result without departing from the spirit and scope of the invention.

EXAMPLES

Example 1

Polynucleotides Related to the PPG Oxidase Gene Sequences

The target PPG oxidase polynucleotide molecule naturally occurs in the genome of *Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis, Ambrosia trifida, Chenopodium album, Commelina diffusa, Conyza canadensis, Digitaria sanguinalis, Euphorbia heterophylla, Kochia scoparia, Lolium multiflorum* and include molecules related to the expression of a polypeptide identified as a PPG oxidase, that include regulatory molecules, cDNAs comprising coding and noncoding regions of a PPG oxidase gene and fragments thereof as shown in Table 1.

Polynucleotide molecules were extracted from these plant species by methods standard in the field, for example, total RNA was extracted using Trizol Reagent (Invitrogen Corp, Carlsbad, Calif. Cat. No. 15596-018), following the manufacturer's protocol or modifications thereof by those skilled in the art of polynucleotide extraction that may enhance recover or purity of the extracted RNA. Briefly, start with 1 gram of ground plant tissue for extraction. Prealiquot 10 milliliters (mL) Trizol reagent to 15 mL conical tubes. Add ground powder to tubes and shake to homogenize. Incubate the homogenized samples for 5 minutes (min) at room temperature (RT) and then add 3 mL of chloroform. Shakes tubes vigorously by hand for 15-30 seconds (sec) and incubate at RT for 3 min. Centrifuge the tubes at 7,000 revolutions per minute (rpm) for 10 min at 4 degrees C. Transfer the aqueous phase to a new 1.5 mL tube and add 1 volume of cold isopropanol. Incubate the samples for 20-30 min at RT and centrifuge at 10,000 rpm for 10 min at 4 degrees C. Wash pellet with Sigma-grade 80 percent ethanol. Remove the supernatant and briefly air-dry the pellet. Dissolve the RNA pellet in approximately 200 microliters of DEPC treated water. Heat briefly at 65 degrees C. to dissolve pellet and vortex or pipet to resuspend RNA pellet. Adjust RNA concentration to 1-2 microgram/microliter.

DNA was extracted using EZNA SP Plant DNA Mini kit (Omega Biotek, Norcross Ga., Cat#D5511) and Lysing Matrix E tubes (Q-Biogen, Cat#6914), following the manufacturer's protocol or modifications thereof by those skilled in the art of polynucleotide extraction that may enhance recover or purity of the extracted DNA. Briefly, aliquot ground tissue to a Lysing Matrix E tube on dry ice, add 800 μl Buffer SP1 to each sample, homogenize in a bead beater for 35-45 sec, incubate on ice for 45-60 sec, centrifuge at ≥14000 rpm for 1 min at RT, add 10 microliter RNase A to the lysate, incubate at 65° C. for 10 min, centrifuge for 1 min at RT, add 280 μl Buffer SP2 and vortex to mix, incubate the samples on ice for 5 min, centrifuge at ≥10,000 g for 10 min at RT, transfer the supernatant to a homogenizer column in a 2 ml collection tube, centrifuge at 10,000 g for 2 min at RT, transfer the cleared lysate into a 1.5 ml microfuge tube, add 1.5 volumes Buffer SP3 to the cleared lysate, vortex immediately to obtain a homogeneous mixture, transfer up to 650 μl supernatant to the Hi-Bind column, centrifuge at 10,000 g for 1 min, repeat, apply 100 μl 65° C. Elution Buffer to the column, centrifuge at 10,000 g for 5 min at RT.

Next-generation DNA sequencers, such as the 454-FLX (Roche, Branford, Conn.), the SOLiD (Applied Biosystems), and the Genome Analyzer (HiSeq2000, Illumina, San Diego, Calif.) were used to provide polynucleotide sequence from the DNA and RNA extracted from the plant tissues. Raw sequence data is assembled into contigs. The contig sequence is used to identify trigger molecules that can be applied to the plant to enable regulation of the gene expression.

The target DNA sequence isolated from genomic (gDNA) and coding DNA (cDNA) from the various weedy plant species for the PPG oxidase gene and the assembled contigs as set forth in SEQ ID NOs 1-71 and Table 1 (See supplemental attachment 40_21(58640)Btable1.doxc)

Example 2

Polynucleotides Related to the Trigger Molecules

The gene sequences and fragments of Table 1 were divided into 200 polynucleotide (200-mer) lengths with 25 polynucleotide overlapping regions and are shown in Table 2, SEQ ID NO:72-429. These polynucleotides are tested to select the most efficacious trigger regions across the length of any target sequence. The trigger polynucleotides are constructed as sense or anti-sense ssDNA or ssRNA, dsRNA, or dsDNA, or dsDNA/RNA hybrids and combined with an organosilicone based transfer agent to provide a polynucleotide preparation. The polynucleotides are combined into sets of two to three polynucleotides per set, using 4-8 nmol of each polynucleotide. Each polynucleotide set is prepared with the transfer agent and applied to a plant or a field of plants in combination with a PPG oxidase inhibitor containing herbicide, or followed by a PPG oxidase inhibitor treatment one to three days after the polynucleotide application, to determine the effect on the plant's susceptibility to a PPG oxidase inhibitor. The effect is measured as stunting the growth and/or killing of the plant and is measured 8-14 days after treatment with the polynucleotide set and PPG oxidase inhibitor. The most efficacious sets are identified and the individual polynucleotides are tested in the same methods as the sets are and the most efficacious single 200-mer identified. The 200-mer sequence is divided into smaller sequences of 50-70-mer regions with 10-15 polynucleotide overlapping regions and the polynucleotides tested individually. The most efficacious 50-70-mer is further divided into smaller sequences of 25-mer regions with a 12 to 13 polynucleotide overlapping region and tested for efficacy in combination with PPG oxidase inhibitor treatment. By this method it is possible to identify an oligonucleotide or several oligonucleotides that are the most efficacious trigger molecule to effect plant sensitivity to a PPG oxidase inhibitor or modulation of a PPG oxidase gene expression. The modulation of PPG oxidase gene expression is determined by the detection of PPG oxidase siRNA molecules specific to a PPG oxidase gene or by an observation of a reduction in the amount of PPG oxidase RNA transcript produced relative to an untreated plant or by merely observing the anticipated phenotype of the application of the trigger with the PPG oxidase inhibitor containing herbicide. Detection of siRNA can be accomplished, for example, using kits such as mirVana (Ambion, Austin Tex.) and mirPremier (Sigma-Aldrich, St Louis, Mo.).

The target DNA sequence isolated from genomic (gDNA) and coding DNA (cDNA) from the various weedy plant species for the PPG oxidase gene and the assembled contigs as set forth in SEQ ID NOs 1-71 were divided into polynucleotide fragments as shown in Table 2 (See supplemental attachment 40_21(58640)Btable2.docx) and as set forth in SEQ ID NOs 72-1381.

The gene sequences and fragments of Table 1 were compared and 21-mers of contiguous polynucleotides were identified that had homology across the various PPG oxidase gene sequences. The purpose is to identify trigger molecules that are useful as herbicidal molecules or in combination with a PPG oxidase inhibitor herbicide across a broad range of weed species. The sequences shown in Table 3 represent the 21-mers that were present in the PPG oxidase gene of at least eight of the weed species of Table 1. It is contemplated that additional 21-mers can be selected from the sequences of Table 1 that are specific for a single weed species or a few weeds species within a genus or trigger molecules that are at least 18 contiguous nucleotides, at least 19 contiguous nucleotides, at least 20 contiguous nucleotides or at least 21 contiguous nucleotides in length and at least 85 percent identical to a PPG oxidase gene sequence selected from the group consisting of SEQ ID NO:1-71 or fragment thereof.

By this method it is possible to identify an oligonucleotide or several oligonucleotides that are the most efficacious trigger molecule to effect plant sensitivity to PPG oxidase inhibitor or modulation of PPG oxidase gene expression. The modulation of PPG oxidase gene expression is determined by the detection of PPG oxidase siRNA molecules specific to PPG oxidase gene or by an observation of a reduction in the amount of PPG oxidase RNA transcript produced relative to an untreated plant. Detection of siRNA can be accomplished, for example, using kits such as mirVana (Ambion, Austin Tex.) and mirPremier (Sigma-Aldrich, St Louis, Mo.).

The target DNA sequence isolated from genomic (gDNA) and coding DNA (cDNA) from the various weedy plant species for the PPG oxidase gene and the assembled contigs as set forth in SEQ ID NOs 1-71 were divided into fragments as shown in Table 3 (See supplemental attachment 40_21 (58640)Btable3.docx) and as set forth in SEQ ID NOs 1382-2221.

Example 3

Figure 2:
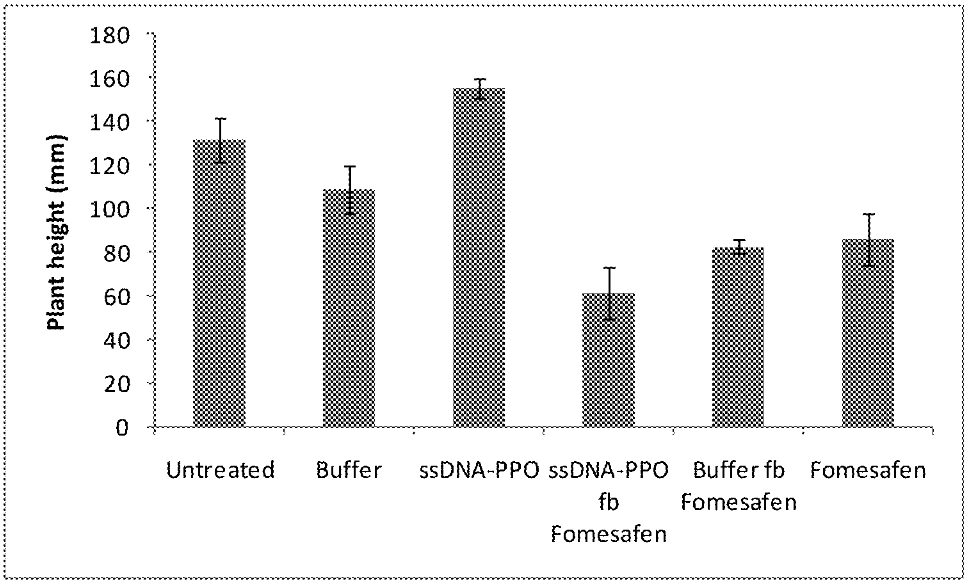
FIG. 2. Treatment of *Amaranthus palmeri* with ssDNA trigger polynucleotides and PPG oxidase inhibitor herbicide, fomesafen.

Methods Used Related to Treating Plants or Plant Parts with a Topical Mixture of the Trigger Molecules Glyphosate-sensitive Palmer amaranth (*A. palmeri* R-22) plants were grown in the greenhouse (30/20 C day/night T; 14 hour photoperiod) in 4 inch square pots containing Sun Gro® Redi-Earth and 3.5 kg/cubic meter Osmocote® 14-14-14 fertilizer. Palmer amaranth plants at 5 to 10 cm in height were pre-treated with a mixture of short (24-25 mer) single-strand antisense oligo DNA polynucleotides (ssDNA,) targeting PPG oxidase coding or noncoding regions at 16 nmol, formulated in 10 millimolar sodium phosphate buffer (pH 6.8) containing 2% ammonium sulfate and 0.5% Silwet L-77. Plants were treated manually by pipetting 10 μL of polynucleotide solution on four fully expanded mature leaves, for a total of 40 microliters of solution per plant. Twenty-four and forty-eight hours later, the plants were treated with fomesafen (Reflex) at 22 g ai/ha and flumioxazin (Valor) at 4 g ai/ha, crop oil concentrate (COC) at 1% is added to the herbicide treatments. The formulation control is the buffer and adjuvants without the DNA polynucleotides. Four replications of each treatment were conducted. Plant height is determined just before ssDNA treatment and at intervals upto fourteen days (dat) after herbicide treatments to determine effect of the oligonucleotide and herbicide treatments. The results shown in FIG. 1 and FIG. 2 demonstrate that the oligonucleotide treatment enhanced the herbicidal activity of both fomesafen and flumioxazin.

Figure 3:
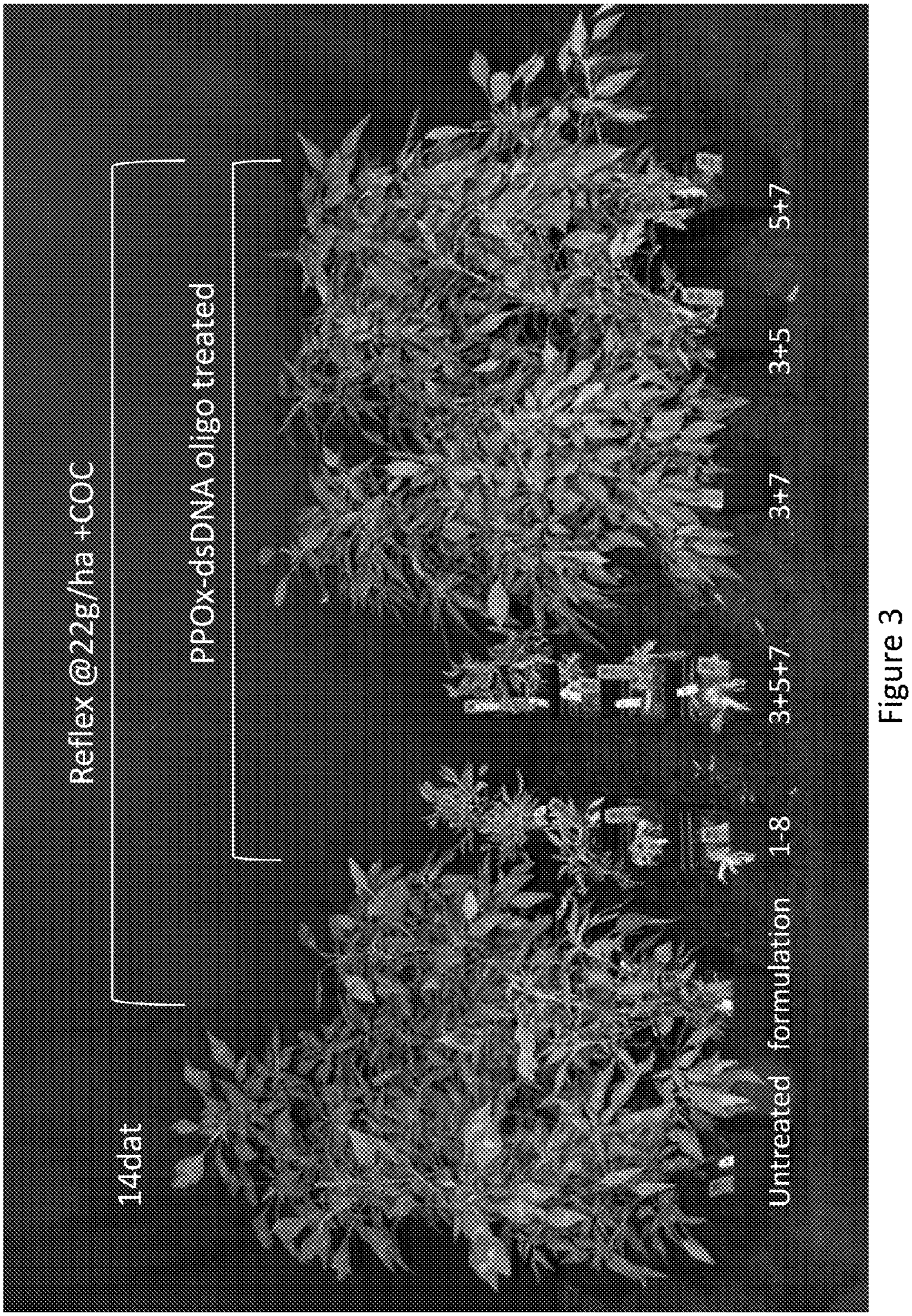
FIG. 3. Treatment of *Amaranthus palmeri* with pooled oligos and ssDNA trigger polynucleotides and PPG oxidase inhibitor herbicide, Reflex® (fomesafen).

A pool comprising eight antisense ssDNA oligonucleotides shown in Table 4 was used to in the protocol as described to treat palmer amaranth plants and the individual oligonucleotides and various combinations of oligonucleotides were tested for efficacy. Surprisingly, it was necessary to have a 3 oligonucleotide pool (oligo3, 5, and 7) of the 8 oligonucleotides to reproduce the effect observed with the 8 oligonucleotide pool and combinations of only 2 of the 3 oligonucleotides was not effective to provide enhanced herbicide sensitivity. This result is illustrated in FIG. 3 for activity on Palmer amaranth, the same 3 oligonucleotides were also active on a related species, waterhemp (*Amaranthus rudis*).

TABLE 4

| Antisense ssDNA PPG oxidase oligonucleotides | | |
|---|---|---|
| OLIGO1 | SEQ ID NO: 2214 | GTGATATTACCTCCAACACGAT |
| OLIGO2 | SEQ ID NO: 2215 | ATAGTAAGCACAGGATCGGAG |
| OLIGO3 | SEQ ID NO: 2216 | CTTTCAATCCACTGTCAACCG |
| OLIGO4 | SEQ ID NO: 2217 | ATCAAGCGTTCGAAGACCTCAT |
| OLIGO5 | SEQ ID NO: 2218 | CAGCAATGGCGGTAGGTAACA |
| OLIGO6 | SEQ ID NO: 2219 | GCAATTGCCCGAATCCTTTTA |
| OLIGO7 | SEQ ID NO: 2220 | TAGCTCAAtATCAAGGTCCTA |
| OLIGO8 | SEQ ID NO: 2221 | TCATAAGCACCCTCTATACAC |

Example 4

A Method to Control Weeds in a Field

A method to control weeds in a field comprises the use of trigger polynucleotides that can modulate the expression of a PPG oxidase gene in one or more target weed plant species. In Table 3 (SEQ ID NO: 1381-2221), an analysis of PPG oxidase gene sequences from seventeen plant species provided a collection of 21-mer polynucleotides that can be used in compositions to affect the growth or develop or sensitivity to PPG oxidase inhibitor herbicide to control multiple weed species in a field. A composition containing 1 or 2 or 3 or 4 or more of the polynucleotides of Table 3 would enable broad activity of the composition against the multiple weed species that occur in a field environment.

The method includes creating a composition that comprises components that include at least one polynucleotide of Table 3 or any other effective gene expression modulating polynucleotide essentially identical or essentially complementary to SEQ ID NO:1-71 or fragment thereof, a transfer agent that mobilizes the polynucleotide into a plant cell and a PPG oxidase inhibiting herbicide and optionally a polynucleotide that modulates the expression of an essential gene and optionally a herbicide that has a different mode of action relative to a PPG oxidase inhibitor. The polynucleotide of the composition includes a dsRNA, ssDNA or dsDNA or a combination thereof. A composition containing a polynucleotide can have a use rate of about 1 to 30 grams or more per acre depending on the size of the polynucleotide and the number of polynucleotides in the composition. The composition may include one or more additional herbicides as needed to provide effective multi-species weed control. A field of crop plants in need of weed plant control is treated by spray application of the composition. The composition can be provided as a tank mix, a sequential treatment of components (generally the polynucleotide followed by the herbicide), a simultaneous treatment or mixing of one or more of the components of the composition from separate containers. Treatment of the field can occur as often as needed to provide weed control and the components of the composition can be adjusted to target specific weed species or weed families.

Example 5

Herbicidal Compositions Comprising Pesticidal Agents

A method of controlling weeds and plant pest and pathogens in a field of PPG oxidase inhibitor tolerant crop plants is provided, wherein the method comprises applying a composition comprising a PPG oxidase trigger oligonucleotide, a PPG oxidase inhibitor composition and an admixture of a pest control agent. For example, the admixture comprises insecticides, fungicides, nematocides, bactericides, acaricides, growth regulators, chemosterilants, semiochemicals, repellents, attractants, pheromones, feeding stimulants or other biologically active compounds or biological agents, such as, microorganisms.

For example, the admixture comprises a fungicide compound for use on a PPG oxidase inhibitor tolerant crop plant to prevent or control plant disease caused by a plant fungal pathogen, The fungicide compound of the admixture may be a systemic or contact fungicide or mixtures of each. More particularly the fungicide compound includes, but is not limited to members of the chemical groups strobilurins, triazoles, chloronitriles, carboxamides and mixtures thereof. The composition may additional have an admixture comprises an insecticidal compound or agent.

The PPG oxidase trigger oligonucleotides and PPG oxidase inhibitor (for example, fomesafen) tank mixes with fungicides, insecticides or both are tested for use in soybean and corn for control of foliar diseases and pests. Testing is conducted to develop a method for use of mixtures of the trigger oligonucleotides and fomesafen formulation and various commercially available fungicides for weed control and pest control. The field plots are planted with soybeans or corn. All plots receive a post plant application of the PPG oxidase trigger+fomesafen about 3 weeks after planting. The mixtures of trigger+fomesafen or trigger+fomesafen+fungicide+insecticides are used to treat the plots at the R1 stage of soybean development (first flowering) or tassel stage of corn. Data is taken for percent weed control at 7 and 21 days after R1 treatment, soybean safety (% necrosis, chlorosis, growth rate): 5 days after treatment, disease rating, pest ratings and yield (bushels/Acre). These mixtures and treatments are designed to provide simultaneous weed and pest control, such as fungal pest control, for example, leaf rust disease; and insect pest control, for example, aphids, armyworms, loopers, beetles, stinkbugs, and leaf hoppers.

Agricultural chemicals are provided in containers suitable for safe storage, transportation and distribution, stability of the chemical compositions, mixing with solvents and instructions for use. A container of a mixture of a trigger oligonucleotide+a herbicice+fungicide compound, or a mixture of a trigger oligonucleotide+herbicide compound and an insecticide compound, or a trigger oligonucleotide+a herbicide compound and a fungicide compound and an insecticide compound (for example, lambda-cyhalothrin, Warrier®). The container may further provide instructions on the effective use of the mixture. Containers of the present invention can be of any material that is suitable for the storage of the chemical mixture. Containers of the present invention can be of any material that is suitable for the shipment of the chemical mixture. The material can be of cardboard, plastic, metal, or a composite of these materials. The container can have a volume of 0.5 liter, 1 liter, 2 liter, 3-5 liter, 5-10 liter, 10-20 liter, 20-50 liter or more depending upon the need. A tank mix of a trigger oligonucleotide+herbicide compound and a fungicide compound is provided, methods of application to the crop to achieve an effective dose of each compound are known to those skilled in the art and can be refined and further developed depending on the crop, weather conditions, and application equipment used.

Insecticides, fungicides, nematocides, bactericides, acaricides, growth regulators, chemosterilants, semiochemicals, repellents, attractants, pheromones, feeding stimulants or other biologically active compounds can be added to the trigger oligonucleotide to form a multi-component pesticide giving an even broader spectrum of agricultural protection. Examples of such agricultural protectants with which compounds of this invention can be formulated are: insecticides such as abamectin, acephate, azinphos-methyl, bifenthrin, buprofezin, carbofuran, chlorfenapyr, chlorpyrifos, chlorpyrifos-methyl, cyfluthrin, beta-cyfluthrin, cyhalothrin, lambda-cyhalothrin, deltamethrin, diafenthiuron, diazinon, diflubenzuron, dimethoate, esfenvalerate, fenoxycarb, fenpropathrin, fenvalerate, fipronil, flucythrinate, tau-fluvalinate, fonophos, imidacloprid, isofenphos, malathion, metaldehyde, methamidophos, methidathion, methomyl, methoprene, methoxychlor, methyl 7-chloro-2,5-dihydro-2-[[N-(methoxycarbonyl)-N-[4-(trifluoromethoxy)phenyl] amino]carbonyl]indeno[1,2-e][1,3,4]oxadiazine-4a(3H)-carboxylate (DPX-JW062), monocrotophos, oxamyl, parathion, parathion-methyl, permethrin, phorate, phosalone, phosmet, phosphamidon, pirimicarb, profenofos, rotenone, sulprofos, tebufenozide, tefluthrin, terbufos, tetrachlorvinphos, thiodicarb, tralomethrin, trichlorfon and triflumuron; most preferably a PPG oxidase inhibitor compound is formulated with a fungicide compound or combinations of fungicides, such as azoxystrobin, benomyl, blasticidin-S, Bordeaux mixture (tribasic copper sulfate), bromuconazole, captafol, captan, carbendazim, chloroneb, chlorothalonil, copper oxychloride, copper salts, cymoxanil, cyproconazole, cyprodinil (CGA 219417), diclomezine, dicloran, difenoconazole, dimethomorph, diniconazole, diniconazole-M, dodine, edifenphos, epoxiconazole (BAS 480F), famoxadone, fenarimol, fenbuconazole, fenpiclonil, fenpropidin, fenpropimorph, fluazinam, fluquinconazole, flusilazole, flutolanil, flutriafol, folpet, fosetyl-aluminum, furalaxyl, hexaconazole, ipconazole, iprobenfos, iprodione, isoprothiolane, kasugamycin, kresoxim-methyl, mancozeb, maneb, mepronil, metalaxyl, metconazole, S-methyl 7-benzothiazolecarbothioate (CGA 245704), myclobutanil, neo-asozin (ferric methanearsonate), oxadixyl, penconazole, pencycuron, probenazole, prochloraz, propiconazole, pyrifenox, pyroquilon, quinoxyfen, spiroxamine (KWG4168), sulfur, tebuconazole, tetraconazole, thiabendazole, thiophanate-methyl, thiram, triadimefon, triadimenol, tricyclazole, trifloxystrobin, triticonazole, validamycin and vinclozolin; combinations of fungicides are common for example, cyproconazole and azoxystrobin, difenoconazole, and metalaxyl-M, fludioxonil and metalaxyl-M, mancozeb and metalaxyl-M, copper hydroxide and metalaxyl-M, cyprodinil and fludioxonil, cyproconazole and propiconazole; commercially available fungicide formulations for control of Asian soybean rust disease include, but are not limited to Quadris® (Syngenta Corp), Bravo® (Syngenta Corp), Echo 720® (Sipcam Agro Inc), Headline® 2.09EC (BASF Corp), Tilt® 3.6EC (Syngenta Corp), PropiMax™ 3.6EC (Dow AgroSciences), Bumper® 41.8EC (MakhteshimAgan), Folicur® 3.6F (Bayer CropScience), Laredo® 25EC (Dow AgroSciences), Laredo™ 25EW (Dow AgroSciences), Stratego® 2.08F (Bayer Corp), Domark™ 125SL (Sipcam Agro USA), and Pristine®38% WDG (BASF Corp) these can be combined with PPG oxidase inhibitor compositions as described in the present invention to provide enhanced protection from fungal disease; nematocides such as aldoxycarb and fenamiphos; bactericides such as streptomycin; acaricides such as amitraz, chinomethionat, chlorobenzilate, cyhexatin, dicofol, dienochlor, etoxazole, fenazaquin, fenbutatin oxide, fenpropathrin, fenpyroximate, hexythiazox, propargite, pyridaben and tebufenpyrad; and biological agents such as *Bacillus thuringiensis, Bacillus thuringiensis* delta endotoxin, baculovirus, and entomopathogenic bacteria, virus and fungi.

Lengthy table referenced here

US09416363-20160816-T00001

Please refer to the end of the specification for access instructions.

Lengthy table referenced here

US09416363-20160816-T00002

Please refer to the end of the specification for access instructions.

Lengthy table referenced here

US09416363-20160816-T00003

Please refer to the end of the specification for access instructions.

LENGTHY TABLES

The patent contains a lengthy table section. A copy of the table is available in electronic form from the USPTO web site (http://seqdata.uspto.gov/?pageRequest=docDetail&DocID=US09416363B2). An electronic copy of the table will also be available from the USPTO upon request and payment of the fee set forth in 37 CFR 1.19(b)(3).

SEQUENCE LISTING (2221 sequences)

SEQ ID NO: 1 - DNA, 1200 bp, Amaranthus albus
ggaatccttgatttgaagataggataaccagagagagtgcgagagagatgagtgcgatggcgttatcgagcagcattctacaatgtccgccgcactccgacatctcgttccgcttttttgctcatacacgaacccactcccccatcttcttcagaagaccacgaaaattatcatatatccattgttccacaagctcaagctcaactgccaattaccagaacacgattacgagccaaggagaaggagaaaaagtattagattgtgtaattgttggagctggtatcagtggactttgcattgctcaggctctttctaccaaacacattcaatccaatctcaatttcattgtcactgaagctaaacatcgtgttggaggtaatatcactaccatggagtccgatggctatatctgggaagagggtcctaatagtttccaaccctccgatcctgtgcttactatggcggttgacagtggattgaaagacgatttggtcttgggagatcctaatgcccctcgtttcgtgctgtggaatggtaaattaaggcctgttccttccaaacctacggaccttcccttttttgatctcatgagctttcctggtaagattagggctggtcttggtgcacttggtcttcgtcctcctcctcctccttcttcttatgaggaatccgttgaagaatttgtgcgccgtaatctcggcgatgaggtcttcgaacgcttgattgaacccttttgttctggtgtctatgctggtgatcctgcaaagttgagtatgaaagctgcatttggaaaggtctggaccttagagcaaaagggtggtagtatcatcgccggtacactcaaaactattcaggaaaggaagaataatcctccaccccctcgagacccccgccttcctaaacctaagggccagactgttggatcctttaggaaaggactcattatgttacctaccgccattgctgctaggcttggcagtaaagtcaaactatcgtggacactttctaatattgataagtcgctcaatggtgaatacaatctcacatatcaaacacccgatggaccggtttctgttaggaccaaagcggttgtcatgactgtcccttcatacattgcaagtagcctgcttcgtccgctctcagatgttgctgcagattctcttctaaatttactatcctccagtcgcagcagtgtccctt

SEQ ID NO: 2 - DNA, 487 bp, Amaranthus albus
taggaccttgatcttgagctacattggaggtgctacaaatcttggcatattacaaaagagtgaagatgaacttgcggagacagttgataaggatctcagaaaaattctgataaatccaaatgcgaaaggcagccgtgttctgggagtgagagtatggccaaaggcaatcccccaatttttagttggtcactttgatctgctagatgctgcaaaagctgctttggcaaatgctgggctaaaggggttgtttcttggtggtaattatgtatcaggtgttgccttggggaggtgtatagagggtgcttatgactctgcatctcaggtagtggatttcctctcacagtacaaagacaagtagtcagtagggctccagcatcctggttaagtaactttttgtagctgttgtaattcagatataaaatagcccacagtcaaacaagtttggaaagatgtaaaagcatgagatacagtcggtgttcattgagag

SEQ ID NO: 3 - DNA, 1847 bp, Amaranthus graecizans
gtgcgagagagatgagtgcgatggcgttatcgagcagcattctacaatgtccgccgcactccgacatctcgttccgcttttttgctcatacacgaacccactcccccatcttcttcagaagaccacgaaaattatcatatatccattgttccacaagctcaagctcaactgccaattaccagaacacgattacgagccaaggagaaggagaaaaagtattagattgtgtaattgttggagctggtatcagtggactttgcattgctcaggctctttctaccaaacacattcaatccaatctcaatttcattgtcactgaagctaaacatcgtgttggaggtaatatcactaccatggagtccgatggctatatctgggaagagggtcctaatagtttccaaccctccgatcctgtgcttactatggcggttgacagtggattgaaagacgatttggtcttgggagatcctaatgcccctcgtttcgtgctgtggaatggtaaattaaggcctgttccttccaagcctacggaccttcccttttttgatctcatgagctttcctggtaagattagggctggtcttggtgcacttggtcttcgtcctcctcctcctccttcttcttatgaggaatccgttgaagaatttgtgcgccgtaatctcggcgatgaggtcttcgaacgcttgattgaacccttttgttctggtgtctatgctggtgatcctgcaaagttgagtatgaaagctgcatttggaaaggtctggaccttagagcaaaagggtggtagtatcatcgccggtacactcaaaactattcaggaaaggaagaataatcctccaccccctcgagacccccgccttcctaaacctaagggccagactgttggatcctttaggaaaggactcattatgttacctaccgccattgctgctaggcttggcagtaaagtcaaactatcgtggacactttctaatattgataagtcgctcaatggtgaatacaatctcacatatcaaacacccgatggaccggtttctgttaggaccaaagcggttgtcatgactgtcccttcatacattgcaagtagcctgcttcgtccgctctcagatgttgctgcagattctctttctaaattttactatcctccagtcgcagcagtgtccctttcttatcccaaagaagcaattagaccagaatgcttgatcgatggagaactaaaaggattcgggcaattgcatccccgcagccagggtgtggaaaccttgggaacaatttatagttcatctcttttccctggtcgagcaccacccggtaggaccttgatcttgagctacattggaggtgctacaaatcttggcatattacaaaagagtgaagatgaacttgcggagacagttgataaggatctcagaaaaattctgataaatccaaatgcgaaaggcagccgtgttctgggagtgagagtatggccaaaggcaatcccccaatttttagttggtcactttgatctgctagatgctgcaaaagctgctttggcaaatgctgggctaaaggggttgtttcttggtggtaattatgtatcaggtgttgccttggggaggtgtatagagggtgcttatgactctgcatctcaggtagtggatttcctctcacagtacaaagacaagtagtcagtagggctccagcatcctggttaagtaactttttgtagctgttgtaattcagatataaaatagcccacagtcaaacaagtttggaaagatgtaaaagcatgagatacagtcggtgttcattgagaggatagatgcaaataacttggacggaaaagtactagttccccattgttt

SEQ ID NO: 4 - DNA, 1170 bp, Amaranthus hybridus
gaagctaaacatcgtgttggaggtaatatcactaccatggagtccgatggctatatctgggaagagggtcctaatagtttccaaccctctgatcctgtgcttactatggcggttgacagtggattgaaagacgatttggtcttgggagatcctaatgcccctcgtttcgtgctctggaatggtaaattaaggcctgttccttccaaacctacggaccttcccttttttgatctcatgagctttcctggtaagattagggctggtcttggtgcacttggtcttcgtcgtcctcctcctccttcttcttatgaggaatctgttgaagaatttgtgcgccgtaatctcggcgatgaggtcttcgaacgcttgatcgaacccttttgttctggtgtgtatgctggtgatcctacaaagttgagtatgaaagctgcatttggaaaggtctggaccttagagcaaaagggtggtagtatcatcgccggtacactcaaaactattcaggaaaggaagaataatcctccaccccctcgagacccccgccttcctaaacctaagggccagactgttggatcctttaggaaagggctcattatgttacctaccgccattgctgctaggcttggcagtaaagtcaaactatcgtggacactttctaatattgataagtcgctcaatggtgaatacattctcacttatcaaacacccgatggaccggtttctgttaggaccaaagcggttgtcatgactgtcccttcatacattgcaagtagcctgcttcgtccgctctcagatgttgctgcagattctctttctaagttttactatccaccagtcgcagcagtgtccctttcttatcccaaagaagcaattagaccagaatgcttgatcgatggagaactaaaaggattcgggcaattgcatccccgcagccagggtgtggaaaccttgggaacaatttatagttcatctcttttcccttggttcgagcaccacccggtaggaccttgatcttgagctacattggaggtgctacaaatgttggaatattacaaaagagtgaagatgaacttgcggatacagttgataaggatctcagaaaaattctgataaatccaaatgcgaaaggcagccgtgttctgggagtgagagtatggccaaaggcaatccccc

SEQ ID NO: 5 - DNA, 2344 bp, Amaranthus lividus
tagattgttgagagggaatgggcaattaagtggaatcccatttccttaaactcagctggtgtatgtaatggtgtctttccaccttcaatcatgtttgcaattctcaaacctttaacatctctaacaacctcttttagctcttctatgttggctggtgcctcaacaaatgtggcatcagcccctgcctctctgtaaagattagcacgtctaatagcttcttgaagaccgtgaggtgcacgagcatcagtccttgcaaccaagaagaaatcagattcaccaatggcttcccttgctgcagcgatcttaagggcgtgctcctctgcaggaacaactgccttaccacgcatgtgaccacacttctttggccatacttgatcctcaaggaaaacacccttggcaccagctgcgatcaagtctttgatgaacctttgaacattaagaggaccaccaccaccggtgtctccgtcaacaataacacacaaactaggagcagctgccgtaattctgcgaacaacatctaccacttctgcagttgtaagcaagccaaagtcgggcaagccaagaagagcagcggaaacaccaaaaccggagacaaagcaagctttgaagccggttttagcgcaaatggcggcggagaaagcgtcttggattccgggcattaaaattggtccctcctcggcgatcagacggtgcattgtggtctttccgactgcctcaagagaacccatttttgtttctaataatacaatttaggaattaaggaaggaggtgatgatgagttgatagaactacttagtgtgtaattgttggagctggtatcagtggactttgcattgcgcaggctctttctaccaaacacattcaatccaatctcaatttcattgtcactgaagctaaacatcgtgttggaggtaatattactaccatggagtccgatggctatatctgggaagagggtcctaatagtttccaaccctctgatcctgtgcttactatggcggttgacagtggattgaaagacgatttggttttgggagatcctgatgcccctcgtttcgtgctctggaatggtaaattaaggcctgttccttctaaacctacggaccttcccttttttgatctcatgagctttcctggtaagattagggctggtcttggtgcacttggtcttcgtcctcctcctcctcctccttcttatgaggaatctgttgaagaatttgtgcgccgtaatctcggcgatgaggtcttcgaacgcttaatcgaacccttttgttctggtgtgtatgctggtgatcctacaaagttgagtatgaaagctgcatttggaaaggtctggaccttagagcaaaagggtggtagtatcatcgccggtacactcaaatctattcaggaaaggaagaataatcctccaccccctcgagacccccgccttcctaaacctaagggccagactgttggatcctttaggaaagggctcattatgttacctaccgccattgctgctaggcttggcagtaaagtcaaactatcgtggacactttctaatattgataagtcgctcaatggtgaatacaatctcacttatcaaacacccgatggaccggtttctgttaggaccaaagcggttgtcatgactgtaccttcatacattgcaagtagcctgcttcgtccactctcagatgttgctgcagattctctttctaagttttactatccaccagtcgcagcagtgtccctttcttatcccaaggaagcaattagaccagaatgcttgatcgatggagaactaaaaggattcgggcaattgcatccccgcagccagggtgtggaaaccttgggaacaatttatagttcatctcttttccctggtcgagcaccacccggtaggaccttgatcttgagctacattggaggtgctacaaatgttggaatattacaaaagagtgaagatgaacttgcggagacagttgataaggatctcagaaaaattctgataaatccaaatgcgaaaggcagccgtgttctgggagtgagagtatggccaaaggcaatcccccaatttttagttggtcactttgatctgctagatgctgcaaaagctggtttggcaaatgctgggctaaaggggttgtttcttggtggtaattatgtatcaggtgttgccttggggaggtgtatagagggtgcttatgactctgcatctcaggtagtggatttcctctcacagtacaaagacaagtagtcaatagggctccaccttcctggttaactaactttttgtagctgttgtaatttgtatcatgtaatattattcagatgtaaaagcatgagatacagtcggtat

SEQ ID NO: 6 - DNA, 1866 bp, Amaranthus palmeri
aatccttgatttgaagataggataaccagagagagtgcaagagagatgagtgccatggcgttatcgagcagcattctacaatgtccgccgcactccgacatctctttccgcttttctgcttatacaccaacccgctcccccatcttcttcggaagacctcgaaaattatcatatatccattgttccacaagctcaagctcaactgccaattaccagaacacgattacgacccaaggagaaggagataaagtattggattgtgtaattgttggagctggtatcagtggactttgcattgctcaggctctttctaccaaacacattcaatccaatctcaatttcattgtcactgaagctaaaaatcgtgttggaggtaatatcactaccatggagtccgatggctatatctgggaagagggtcctaatagtttccaaccctccgatcctgtgcttactatggcggttgacagtggattgaaagatgatttggtcttgggagatcctaatgctcctcgttttgtgctctggaatggtaaattaaggcctgttccttccaaacctacggaccttcccttttttgatctcatgagctttcctggtaagattagggctggtcttggtgcacttggtcttcgtccttctcctcctcctccttcttatgaggaatctgttgaagaatttgtgcgccgtaatctcggcgatgaggtcttcgaacgcttgatcgaacccttttgttctggtgtgtatgctggtgatccttcaaagttgagtatgaaagctgcatttggaaaggtctggaccttagagcaaaagggtggtagtatcatcgccggtacactcaaaactattcaggaaaggaagaataatcctccaccgcctcgagacccccgccttcctaaacctaagggccagactgttggatcctttaggaaagggctcattatgttacctaccgccattgctgctaggcttggcagtaaagtcaaactatcgtggacactttctaatattgataagtcgctcaatggtgaatacaatctcacttatcaaacacccgatggaccggtttctgttaggaccaaagcggttgtcatgactgtcccttcatacattgcaagtagcctgcttcgtccgctctcatgatgttgctgcagattctctttctaaattttactatccaccagtcgcagcagtgtccctttcttatcccaaagaagcaattagaccagaatgcttgatcgatggagaactaaaaggattcgggcaattgcatcccgcagccagggtgtggaaaccttgggaacaatttatagttcatctcttttccctggtcgagcaccacctggtaggaccttgatcttgagctacattggaggtgctacaaatgttggcatattacaaaagagtgaagatgaacttgcggagacagttgataaggatctcagaaaaattctgataaatccaaatgcgaaaggcagccgtgttctgggagtgagagtatggccaaaggcaatcccccaatttttagtaggtcattttgatctgctagatgctgcaaaagcgggtttggcaaatgctggactaaaggggttgtttcttggtggtaattatgtatcaggtgttgccttggggaggtgtatagagggtgcttatgactctgcatctcaggttgtggatttcctctcacagtacaaagacaagtagtcatcctgattaactaactttttgtagctgttgtaatttgtatcatgtaatattattatttattcagatgtaaaagcatgatatacagtcggtgttctttgagaggatagatgcaaataacttggacggtaaagtactagttcctgtctcttatacacatct

SEQ ID NO: 7 - DNA, 1066 bp, Amaranthus palmeri
catgtggtggagatcctcaatcgctatctatgcaccatacatttcccgacgtatggaatgttgaaaaaaggtttggctctgtgtttgctggactaattcaatcaacattgttatctaagaaggaaaagggtggagggaaaatgcttctatcaagaagcctcgtgtacgcggttcattttcattccatggtggaatgcagacacttgttgacacaatgtgcaaacagcttggtgaagatgaactcaagctccagtgtgaggtgctgtccttgtcatacaaccagaaggggatcccttcattagggaattggtcagtctcttctatgtcaaataataccagtgaagatcaatcttatgatgctgtggttgtcactgctccaattcgcaatgtcaaagaaatgaagattatgaaatttggaaatccattttcacttgactttattccagaggtgacttacgtacccctttccgttatgattactgcattcaagaaggataaagtgaagagacctctcgagggcttcggagttcttatcccgtctaaagagcaacataatggactgaagactcttggtactttattttcgtctatgatgtttcctgatcgtgctccatctgatatgtgtctttttaccacatttgtcggaggaagcagaaatagaaaacttgcaaacgcttcaacggatgaattgaagcaaatagtttcttctgaccttcagcagctgttgggcactgaggacgaaccttcatttgtcaatcatctcttttggagcaatgcattcccgttgtatgggcacaattacgattctgttttgacagcaatagacaagatggaaaaggatcttcctggattttttatgcaggtaaccataagggtggactttcagtaggaaaagcgatggcctccggatgcaaggctgcggaacttgtaatatcctatctggactctcatttatatgtgaagatggatgagaagaccgcgtaatctttctgaaattccttcactgtaaccaagcgtgtgaagcccctgattttgcgtctgtatatccgatgatatatcgctggat

SEQ ID NO: 8 - DNA, 294 bp, Amaranthus palmeri
ggggagcgggttgctggataaccagagagagtgcaagagagatgagtgccatggcgttatcgagcagcattctacaatgtccgccgcactccgacatctctttccgcttttctgcttatacaccaacccgctcccccatcttcttcggaagacctcgaaaattatcatatatccattgttccacaagctcaagctcaactgccaattaccagaacacgattacgacccaaggagaaggagataaagtattggattgtgtaattgttggagctggtatcagtggactttgcattg

SEQ ID NO: 9 - DNA, 6448 bp, Amaranthus palmeri
ggtgtttatttgggcatggccttatgtgtgatgttggtaaattttgtggcttcgtccactaatctgatgtatcggatctgttaaagggagccctctcatcctatgcttatcaatgactttttcatatgcctatcaaacagatcagattggatcgggttcgagttcaggtcatatataaacatgtcagcaaacccttgacccatacccaacccatttagttaattggcttgaaaatcacaaccttaattcgaccagcgacagatcaggttgacctgatttcgacccacttaacccatttataatttttttttcgatttaagttttttaacattgattaaatctaattttttaggctttaattttaattttatgtttttttgtttaatttgtatttactatgaaaaataagaaactattatatgaactgagtttagcttacacttattaatttaactcgaaattaacacatttaattaaatggttatatagggttttttagttttaaaatttcaacctgaacctaatctatttaataaaaagatcagatctgatcaacccatataattaattgggtcaaaatctcaactcaaacccatttatttcgaattaaattcagatcaaattagcaggtcggatcaactagcgctaatttttcctctcaagttttttcatatgatgccccttgttttctttgaataaaattcaccaatttaaaatccctgcccttgatccgttggtattggtatttggtaaagcacatatggtaaattctactccattgttatctgtagttttggttctaaaccccaaacaaatcctactcctagcaccactaatcctcattactttctgtttgctgtctttctctacattcctactaaattaagacctagatgcagtgttattctgttcgaggttgccgaaaacggtacaatagttgcctaatttgcaattcatgtttgttcttgcgttttctacattgtttactctattggaacaaaggttgaactttcagcctttcagggagtattttgatttttctgtcaaattaccttgccagatttatttggctattttgattgtgtgtatttctttgtcccttgtttccatggggctaaactccttttggttaatcttaaacatttcttctaattttgaattgcagtggtatgaagtgttgtttaatatacaatcaatttttctgaactgggttaatgaagagaagcattgtagacatgaggaatgtgttcaagcatctcaaaacaaccaaattaatcccaaatgggatcttcaactgtaatagaggtaaatcacatatattctcatttaatggttattgttttattttaaggatgttattatgttgttatcaatgatagaaataagagaagcttgagcattcaaatgtatctatcactcactggttgtggacatctaaaatatggaccaagagttttcttcatttcttgtaccagaatttgcaaatgtatgattaaagtttaggttggagttgcaataaaatttcattaccccgacgctattaagtggctcacactgaggcggggtttgagggtcggatggtgcaaccttcaggagaggttctaagcattttcaacatgttcaaccgcagagggtcccgtaaaattggaggcttcaatattaaattatgtagtatgtgttaagtgtttaaagatataaaaatgttaatgaatacataatttttaaaattgcacagggctttcaaagaaatttttgattttgctccgcccatggcaacctttggcaaatctggatagaattagagaaatttacttttatgtatgtataatctgatgaatgaatgaatgaacaatgaagttcatttctgagtcaatgacctatatactatcgaggtttcgttaaataggatatataaataaaattagagacatcttttatccctaatgttgtctgttttcttttctgggcgagactgtttttggagaaaaacgttatgttgaatgcttgatttactcagaactgatgcaaacagatggataaaaaatggtgttttcctagtgtttatgtttcataaaaggatttcaaattccaatcgtatgaagtttgaaatactgctttttgtttttgtagcttcgtgttttgctttccttcactcttcaccagggaacgttgttgaagtttgttccaagaagcaagaagtcgtaattgcaatcgggagcaatgttggtgacagattagaaaatttcaaccaagctctgcaacaaatgaagaaattaggcatagacatcacaaggcatggttgtttatatgagacggaacctgcatacgtgactgatcaaccgaagtttcttaactctgctttaagaggctttacaagacttggacctcatgaattattaggggtattgaagaaaattgagaaggatatgggtagaaccaagggaataaggtatggtcctaggccaattgacttggacatactattttatgggaagtttagggtgagctctgagagcctcactatcccccatgaaaggatatgggaaagaccatttgtgatggcaccattgattgattgtattgggtctgatgtagaaaatgacactatttgtacgtggcattcattatcaaatttttcgggtggaatctttgaagcatggggtaaactcggtggaagctccctaatcgggaaggatggaatgaaaagggttttgcccgttggaaatctcttatgggattggtctcataaaacctctgttatgggagtcttgaacttgactcctgatagctttagtgatggcggaagttttcaatctgtcaatactgcggttgctaaggttcgtcagatgatctcagatggggcagatataattgacatcggggcacaatcaaccagacccatggcaactagaatttcggctgaagaagagctagcaagagtagtacctgtattagaagctgtcaaggatttgatcgaggaagaaggaagaatcttgtcagtggatacgttttattctaaagttgctttggaggccgtcaagaagggggcacacattgtgaatgatgtctctagtggtaaactcgattccgagatgtttaatgttgttgcggaccttaaagttccttatatagcaatgcacatgcgaggagatccgacttcaatgcaaaactctgagaacttgacctacaatgatgtttgtaagcaagtggcttcggagttgagttctagggtcatagatgcagaattatcgggaattcctgcttggaggatagttattgatcccggcatcggattttctaagaatacgaatcaaaatttggaaattcttagtggtttacaaaagatacgggaagagatagctaagaagagtttggcggtggctcattgccccttgctaattggaccttcaagaaagaggtttctgggcgagatttgtgagcgccctgtagcagctgacagggatcctgctaccattgcttctataactgctggagttttaggtggtgcaaacattgtaagagtacataatgttagggataaccttgatgctgtcaagttatgtgatgccatactcggaaaaactgattaactgcttgtttgtaccaccttgtgaatgatgtctagtggaaggttcgattgggattatgatgaagtccgttagtttgctcgaaagaagagctttagcccgtaaggttatagttcttacagatgtagaatcattggctatttgcctatttctgcttagaagatcatagcattgatccagactttggattccatgtagaattatgttgcgactcatggtcgaattggccctttgaggaattgttgaagttccttgagtctatggttcaatcggctcggttcgatgaaggttggactgtgtcgagacaagatgggtcaaagagaccaatggacaagaagtcgaccttgggcaagcttgatcaagttacttggacgagcagataacagcaggctctggcgagcattagacatacatatcatttgttttttgaagtcagatctgcaatcaatcagttgcaatggacagaccatatacggttgttagttgttcctgtcactctttgagttgaattagatcatgcaaacactgtaagagtcttgattttgtgaagctatgtgatactgtacttctcaaaatgaaatctttgatatgatgttagcttcaagagttgtttttccccccctcacattctgttctatgttgtattgttgtgtgctttttggaattgtattcctgtaattagaattattcctgcaaaatggtattcctttatatcatcaaaggagtttttgtacttctaatcattgatctttagatgcaaaactgaattaatacaagtgttcttgatgaaggcttattgaagaactcactttttatttatgtctaaacttgttaaagatgttctgcttccgcccttgccacgggatgtcgggattgactaagggtggtaatcgagggattcctatgcttgaattgactcgtttaagattttgcgttgattttaagtcaaatgttttgctaagcataaactattctagctcgacttgaataatgaagttttcgagtcaagtccgagctgttctgtaagtttatgtatcttgaagcttcttagttcttacttcttatccttatttgtttgacacattgaaccgcgttgatgcttgcttgactcaacccgttaaagtcttgaattcatcacgaattcgagtcgagcaagtttaaacccaacattaactaagctctcgaggcttaatgaggcaggggtagctcaagtttgttattcaagcaacttaccatagtattcttttaaaaggcatatagtcagttagttatttgttaatttcagtagaacgaaagaagtacattattaaacttggccattgatgcttgagctagagagcttcggttgtgatcgaaacgaatcctgatttcgctcttgatctttgatgtgaagtgacaaggccttcataaaactcctttattcttcagcagtgcatacaaaaatcatgtgtgcccagctcctagctcacataccgcgtttttcccctaatctagtgtggtcaaataaaaacagcaagatgtgttgatgtcatgtgcaatagtaattatcaggtgaagtaatgcaatatgtagccagtcacctcatatcaaaaaaatgttgggaggaaaacgtattcgttcatcactaaacctgtgtttatacatctaactgatcgatcagggtttcaaaatccaaattaatacaatggcatttgacgaagatatccagaacacatcccccttgtttctgctagataatcaactattctgattctgctgtaatacctcagcttcggccctagccatgggatcgtcctctttttctccttcacgctcctcggccagtttctttctgtgcagttcttcagcagcttctattgaagctttgttctcggcctgaagacgctgcatttcctcttccatttgctgcctctcaaaccatgtatcagcatccgcccaaactgcagacaagtatacaaaagttaaataacgaaagtcttcaaaactgcagatccagtgaacaaagtcattgttgccaatgcccatgcaaaccgcaaaacagcagggcaaaagaacacaacattgcagcataaagagcaagttcagtgatctacagttactacaaaatttaggtttgggataccagcatgtcaatatgaatgaatttgctaatacatgtaacccaagaactataagtctataactaacaattaagaaaagaaaaccagaagttccctaccactggagtattagcaaggtaacgactgcctgctgataagaattattggcctggaagtctggaactatgtgatgatcaacatgtgttgctattctaggtaaaactaatctatcataatataattaaactacaggccccagaattggggtcctgagctattgatcatgctgttaaagcaaaagagttgggctgaatgagactagcaattaaaagcataggatacactgaacaatgcttccccctccccatccaaacacgtaggttttagttacacaatagtggcttgagctagaaaaccataaggatatcatagtggacacatcatagttaagttttacataaatataccttatacatgtataagcaatacatttccaggttgataggtcagttttatgtctatattgatcgccattctattatgagggaattatattccaataatgggtaatcatcaatgagcagtatttataggaatttattgatagcgtttctattattaggatatagaaattccaataataggtaatcatcagtgagcagtaattgacttatcagactctctggcagcatagtgacaacatgctgtttgtgaaaaggggataaccatgattttgtcttttctttgcaaatgaagctcttt

SEQ ID NO: 10 - DNA, 5240 bp, Amaranthus palmeri
attatatgtcatgtaatataaatagaaaattattatttaaataattaatttcaaactttgtatcaataaaacacttaattttttgattattagagtgtatatgaaaaatatgtaaaaaaaagtcgtacataagaaaatttcattgtaattaagactaaatttgatgaatcgattcgtaaaattgctctatgatcctacaacccacttatttatttcaattaggactgtaattaagtttaaatttacattagttgaattattgccttttatgagagatgtggtatcgtatgctatctaaaggctaaaactattaagtcgatttaaaatctatccaaattttatacttaattgaactaggttgaattgaacggagaattaatcaaaaatgtaccacccttgaatcactatcaatattaaagcaaaccaactttaatccataaatgaaaatcaacttagtcaaatcacatatgaacccgtcaatcatgccaaaaactctgagagtgtttgatattataacttattagaaaattttaacttatttgacgcaaatagacggataagtgttctaaccatctagctctagtgtttcgcttaataaaaataaataatttttaaacatgctcctataaatcaactgatcaaaccggtttataaaatcaccaactaaatcgacccattcaaatcaaataccaactcggtcgtttgccaaacacttcgctatgacttcaatcaaacaaaatgcaacttgtttgctgctaccgacttaccgccttacccagtacgcggaaaagataatcaatgagaatcaaattcaaatcttgacaagataatatgattatcccattattatcaatttaattatgattaaccttttttaagataacctaataattcattgataagaatgattagcttgtttaatcaacttcaatttacaatttctaccttggaaaattcaaaccaaaaagtgtaaaagaattgatttggcagattgcgacaattggattgagaaattgacaaatttaaactgatcttatggtaattcaatccataacccacctttcaccaaaacttgcattgccatcgccattgtcaatttccgccaagaactacccagtagctgtaatgggcaacatttctgagcgggaagaacccagtaagtcaacctttcttcatatatcttaagcaatcccttttgaactacactttcttttgatgattttacattctgaattgtttttattggggattttcagcttctgcgaaaagggttgctgttgttggtgctggagttaggtaaattttatgttacttttccagaaagattgtgaaattttgctttgattgttctgaattttgatgggtttttgcataatgatttgtatttgggatgggcaaatttttcagaagatcatactactttttaacttgtgttttctgtagaattttattgattttctaaactgtttttgtgggattgttctagtggacttgctgctgcatataagctaaaatcccatggtttgagtgtgacattgtttgaagctgattctagagctggaggcaagcttaaaactgttaaaaaagatggttttatttgggatgagggggcaaatactatggtaatgtttatcaacaatgctggttttctgatatagaaccaattacttatttattaactggatttttggtcaaacctgtggttggcatgtcactttatgctatgattgtagacagaaagtgaggcagaggtgtcgagtttgatcgatgatcttgggcttcgtgagaagcaacagttggtaagttttccgtctaagcccattccctttgctctctaggtgcaaaaatacggtaatagtcatgatcgtggtaatgacatggtgatgcggtgacgggagttatgtgatcgctattccaactataggtcgaaaacatgatattttccttgtgacgttccgaaatgcggtatttttacacctttacattgcggggaaaaataggtttagtttttttgaatacctttacaaggcggctgatgcgatgaagccttgtttttgcattatgtgctagaagcaaattattatatctttaattaatgtaatgtatcatcagcttaaaacagccttattgtacttcttaatctagttttgacttttgaggttgcttttacgagatccttataaattgctttttctgtcacagccaatttcacaaaataaaaggtacatagctagagatggtcttccggtgctagtaagtcctctgcattttcttttgacctctatgaacttctaacactggatactgagttgtatttgtattcgaggcaaattctatattttccaatctgtttcttattgacagttacttgcaacctttgcagctaccttcaaatcccgctgcactgctcacgagcaatttcctttcagcaaaatcaaaggttatttatgctaaaacatgtttgtttgtttttttttaacttagcttttggtgtatgcaataatttggtttctaaaactaagtgattgaccgaaaaggagggacaaaggacatagaattgcaaatttttgttcttgacgtatttttacttttagagcatccccttgtgtaaaacttttattttagagctgcaagaatttgttgcatcttttgttatgatttaattttgatgcttttagctgcaacagtttgttgataaaaaggccactgcttttttctcagctgcaaattatgttggaaccatttctctggaaaaaacgcaatgctactgagctttctgatgagcatgttcaggaaaggcaagtgcccttgctctatctatactgatggaaaggattatcgctgaatttaccttctactgaaacatcaataaaatacttcattattagcatcaaaatactccctccatccttctggttttgctggactttccctatgaaggtgttcaaggagtagcttgctacctttcaagatagggtagtggttgccttctcgcaaaatttcagtcactcgttttcctctcctaattcaagccatactttttatggttcctccacacaactcttgctaaatttgaaaagtagcaaagaggaagtgagcaaaatcagcaggagtaggactgatgagtaagagcttgatcaagtataaaggatatgtttctatgtagaatatgaatgcattacctgtagaattgacataatgatttgtctgcagtgttggcgaattttttgagcgacattttgggaaagaggtattgttgccaacttgccatgctctattccggtgaattaacaaatgttgcgcttctgcttactattgcttataattattgtttttttgcagtttgttgattatgttattgacccttttgttgcgggtacatgtggtggagatcctcaatcgctatctgtaagttaaatactgtgccttctttttttttctcaaaattttctggaggttgtaaataaattatactccctcctattataatcaactgtcctatttccccttttggtatattcaaagtgagttaaatattgccatccattaaatttcactttgtcccttacttattttttcccttactcactcctctcatgtggtcccttaaactcggtgcattaccaaataggactattgattgaaataggagggagtatccgattgtgcttccaaaggtagttcaactcctcttctttttctttaaatttttgtaccatactgtgcattttgaaccttaactcatttcgccatgaaggagtattatatttgagaagaacgcagatactattatcttatacattaggtttcattatcaatgattgtttgattgtcaactcctcttttccctttcatgctcatattgatgttatttctatttggttatgaattttgtgtattgtgttaatgtcttactttattgtagatgcaccatacatttcccgacgtatggaatgttgaaaaaaggtatgaatcttaaagctttaattttcttcgaacgttatgtttcataattgattctttgggatcaatttccgtaagaacgataatttgaaaaaatttatgaaccttcaagctttcttcgaatttatatgctttgtaattcatgcttttagatgctgcaccattttatctatgtgtcttaagtttggtgtaatcatttgtatagcaaaagaatgaatggtctggtttgaaatggttcatagtgcaaaatgtgattgtgcttgcgattgaggtaacattcaaggtgatgcgattgtcgtactgtcaattgtcgtcctataccatgtgatatttgaataagcctaaaatgccatattgtacacctttaggatgtggacaaaatgggttcggtttcggtacatatgacaaatccttgcaatttgatctgtacgatacaatgcgattttgtcttttgctttatgatggtgattccatatgcgattttagggcttagaaatttcccttgttcaagaacatctcaatcaatctttaaccaatttcaaccacattaaattgcgtcaaagtcgaactttataattcactcccaatctctgagatatccaaactccaaaagttctattggctttcatgttttcacaaagtaacgttggtgggactccttaccattttctttattatgcatttcgttgatgtataatagtatagattggtgctcttttcgctgtccttctaacatgcataacttcactagttcttatcgttttcttttcctccctatttttatttgacttgtagctatctatgttcactcttctcgcccaatccaatgttatcttctactccatgcttgcaaaagccacaaaatgctcactccaccaataagaggaaattgccagtccaccacttgctggaggcatccatggaagctgaagtatttttgtcctctactcataggatgcatacatgcatcgatttactttctaatactcctttaacttgattccgattagctctgctcttaacaggtgttgctagaaaacatcaactattttcagcataaattaaatgtgagcattacctaataacgtgaaaactatcaaatcttgtttgtagtgcaatattgcgttttcggttgcggttgcatttacgatcgcaaagcgaatttcttggtcaatgtggatcgttctgcacttgcctacattccatcataataagctcaaatttgtttcattgtattttcgtaacaagaacaaaattattgtgtaattcttccctca

SEQ ID NO: 11 - DNA, 2936 bp, Amaranthus palmeri
tcagatatgtcttcataaagtattcaagtttgagcatgaaaatccacatgtacatgacatgagtatgcaaatgcaagtaatacaaacacataggcaaaagagatgatgtaatcactattcggtaatcgctcgcgcacaaatagtagctcactatatgaatgagatgagaaaatttcaattgttgtaaaggcgagttccttatgttttagtccaacagtgttttgtaacctttgtgtaattttttatatgaagcacaagagcaggtctcaaataagtacaggagataaatgaaactagaaataaaagtgttcaatatacttggacatagtcacatagttaatgccaaaatccatctttctgataagttggggccacttatacactatactaacatgagcctggaaagaaatagccagcaggaccgcaggtatagattgttagctaggaaaaccacaaaaccatactccctccatattaaaatgacattaacaagtgattagtaatgtaataacctacttacatattctaacaagtgattaatttcaatagtattccgacaaaatgtagctttaataattatcttccatctcatcaaatttgtttgggaaatttgtaacactgatcaatgactctagcacaaggaatagctaaaattatcatcatcatcatgatcatcttgactagtgtatcccactcataaggaaactatgatcagggtctggaaagggaaggaaggcgacaaatcataccataaagggagtttagaggtaatgaatacctaaatcctgatcctaaaacaattgatcttccccattaccacgccaatatcaacccacaaagcatccggggaaagtcaaacaaagggaaaaatcacaattgaaatatcctagtttcaagtttcaaccaattgggtaccatttacccatgttcaagtgtagcaaaaaccctaatatagcatcttaatacagctccagtaaacattatgcagtcttaatctgaagctactataccaaaacgactaacatttaacaaatgccattccaccattaaaaaaaagggtgttttagcggtaatgagttgatcggtcaatgtcaatccgagtaagaaaaaattaacacaatgcaaacccatttgccatgtttcaacacacaaacacaaaacactgataattccacaaatctgatactacaagcagcacaacagtcaattgcaaacataaccaaaaaaagctaaataaacagcagaacctgggatcggaaaagggtggtcggcgtcgtgaacaaactagagagagaaagatgaatatagagagataaaggagtgagaaagaaggaaggagagtaagcagaatgaaatgggtagtgtggagtgtggaataatggttgaaaatgaagtgtggctcttccatagaggatagggatgctgaaattgagtggtgaataaacaatctgaacaagatttggagaatgcaaaagaatctctggactaaattaatggaaaatcaaattgtatgtaatgatttagatatttaattagggttcttgtttgtgtctactcattctgtcactcacatgcatgctcattgtttgtatcaatctaaagccaagcattgactttttgggaaagccaaatagagaaaacaatatcctaaaggggaaatggactcataaaacgtgattgttactcccacctacagatgttcattcgggtcatcgagttgatttagggtcaggtgtttcgggtaggttcaaaatcgggttttgtgttcacattgatttttacatgattttaaattcatattgacgtcgggtcaagtcggattagattattaactcgggtaaatatcggatcatcgggtctgttttgaacacctctagtattttccaagttttgttgtatcacacatgcttgttgtggatgacctaaaattctttactgctgaaacgggacattctgtgttgcgttacatttggtttttagtagaatataagtttcggtgggttgttaaggcaaaaaacaagcagatgagaagaaatgtgtggctgagatgaatagagagatttttgcggatagaactaggaaagggcacgtgggttcatatccgtaagtaaaaagttagcatataactatagaacaccgaaaaatgaaaaatgtagcgaattgataagtgatcatatgcaatataaagttctggtgttttctgatatattcttttgtgactaaattgaacgggaaaccatcaaaaataatcgtctgtcaaggtattgaaaatcctaacttgggctatcggtgtaggtaaccataagggtggactttcagtgggaaaagcgatggcctccggatgcaaggctgcggaacttgtaatatcctatctggactctcatttatatgtgaagatggatgagaagaccgtgtaattcttctctgggaacgtcccctgattttgcgtctgtatatccgatgatatgtcgttggattgatcacgattgtagtcacgtttaggagttgtgcagtgacttttctgcctaaagactggatctgttagaaacaaatagtctatagatagtttctttgctcatcaggttatctttcttacaccagttgtgtatacaaatgttgcatagcctaacctaaattctaaaatgccattcccttttatatagggtcatgttttttgcatttatgaatggtgaaattttagatcttcactgagaataaaggttttggcaatttcataatggtgcttattaggggtatttaaaaccggatattggcaattttcattgataatattgtaatggaaaaatgacgttaaatatctttttcggtttacgtatcgaaaaatagacaaaaaggtacttgtttcgaccagatttacaaaagagttatcccattaggttaatcacgacgtccgtttttttgaaaaaaaatcgtta

SEQ ID NO: 12 - DNA, 1923 bp, Amaranthus palmeri
taaaaatgacgttaaatatattttatttttattttgttaatttatgtgttttaattataaagtattaaaaaatacgatgattaataagatactgctacatagacaacttaacctctcaaattggtcaaacccttaaacttaacggttaactaacgttttccattaagtgatagtcatttgcagagatttatattagattaggtagttttttgcaaaaaaaaaaattacattaggtagttttttgcaaatagacctatagattaggcagtttcttataatttttccttcttattatttgttgtttcagatatggcttcaagaatgaagtttggtaaccaaacttttcaaatttgaagtgagggttggagctctggtgttggaagccttttttgtaacaccccaaaaattttaggcaaactttatacgtttgtttatccaaaaaaaaaataataaataaataaaaaaaaaaaaattcttaaagtagaaccacttaagggtcggaggtctaggtaataattttggagtgataaatgtaaagattgaagagtttgtaactcataccattagttcactcatttacctcaatttatgattataattaagtattacaaaaaaaaggggaaacaatcacttcatattccaaaggtgaagcttttaatagtgaaggaaaaggatttcttaagcaatacagtattaaacgtaaactaaaaaaaataataaatcatatcttaattttgagaagttttattcttaatttgtttatccctatcaatactaagcttgggataataaacaaagggttatcaaggttggaggatttttaatttcgagattatatacttgaattgaagaaattttatgttcaagagaattatattagaggaatatttgtaaggctattatctacaattcttcatatttctctaattgaaatatatataaaggtaactagtttaccctctcttttcttaattcatatacattgttattttttttattatatggaaaatataaaacggaaaaaaaaatgtaaattaaacttatcttagttttgagataattgatgttatatagtcttataatgttgattaacgttgaaaattgaattacaaaactaaataatttaaacatatgatttgttaacttctactaattaaatcttggttaggggtgatttagttgatttgagaaatatccaaataaataattagattagtttggtgaaataatatttttttttgacttcgaaaacaatgggttaatttggcacactaatttggaatgtacaaataagttcattagagtagagcttcttaaattatgttttggtatagttaaaagtgatgttaatgtatggttaatattttataaatattttatatattttgtttagttgaattggccacttaatgaatttgtacattgctgttaaaaaaaaagagaggatattaatcgtttggtacaacagcataattgagcaaatcataaatctgccaaaattcaagtaattaaaaataattatcaattaacagttatacaagtgtatgtatgtggcattagcctaattgattgcgcaaggactaaataattacttattcaggtaatttagtattttatccaggttaattagaggttagttgagttgattatgatcaatattttggttaaatataaattttggcaaagaaaaatgagtattaatattgtatttattttgagactcgacaatttttagttgaattgttactttctaagatgttaagagtgttgttgacatagttgtacttttgagtagaataacactatcattagtacctctttgccaagagttagtaatagggttgacttttgttgacttagtcaaatttatagttgactttattcccaaactcagacattactcataacatcaattttggtatt

SEQ ID NO: 13 - DNA, 2787 bp, Amaranthus palmeri
acataaaaccgctacatggaggcacggttttgtgtcaaatgtaaaccactactccatgtagcggtttggtgcacatacttttcaactctcagtgtgttgctgacgtggacggtagtgcgggaattattttacaaagtaacgtaaagtgggaattttttttaaataagctgcattttgggcaaagactctacttttacttttaattttatttttaattttaataaagaaggaagaaaaaaaacaaatgtatttatggataaagaatccttgatttgaagataggataaccagagagagggcaagagagatgagtgccatggcgttatcgagcagcattctacaatgtctgccgcactccgacatctctttccgcttttctgcttatacaccaacccgctcccccatcttcttcggaagaccacgaaaattatcatatatccattgttccacaagctcaagctcaactgccaattaccagaacacgattacgacccaaggagaaggagataaagtattggattgtgtaattgttggagctggtatcagtggactttgcattgctcaggctctttctactaaacacattcaatccaatctcaatttcattgtcactgaagctaaaaatcgtgttggaggtaatatcactaccatggagtccgatggctatatctgggaagagggtcctaatagtttccaaccctccgatcctgtgcttactatggcggtaaactcattcttctctctttctccaatttttgatcattctattcaattttccccttattgagtcaaaatcaaattccaggttgacagtggattgaaagatgatttggtcttgggagatcctaatgctcctcgttttgtgctctggaatggtaaattaaggcctgttccttccaaacctacggaccttcccttttttgatctcatgagctttcctggtaagattagggctggtcttggtgcacttggtcttcgtccttctccccctcctccttcttatgaggaatctgttgaagagtttgtgcgccgtaatctcggcgatgaggtcttcgaacgcttgatcgaacccttttgttctggtacctaccctgtttaatttttcagttttcccccttttttctctactactcctactttattgattcttatctatgagtgttctatgggaattgacattaattgttcaggtgtgtatgctggtgatccttcaaagttgagtatgaaagctgcatttggaaaggtctggaccttagagcaaaagggtggtagtatcatcgccggtacactcaaaactattcaggaaaggaagaataatcctccaccgcctcgagacccgtccgtaatcaccattactcattgctttccttcaccttgtatcttaccttaatatacatgtatttaattgataatgtcacattgcctcatttgcagccgccttcctaaacctaagggccagactgttggatcctttaggaaagggctcattatgttacctaccgccattgctgctaggtatcttttgactctcaaatcttaaatatttctcatcttttccttctgctaatactagtatgtttaccatctttttatttttttaggcttggcagtaaagtcaaactatcgtggacactttctaatattgataagtcgctcaatggtgaatacaatctcacttatcaaacacccgatggaccggtttctgttaggaccaaagcggttgtcatgactgtcccttcatacattgcaagtagcctgcttcgtccgctctcagtgagtatcattctttccttcatttcttttcgtttattgctgtccaatgtcttgttaaacaccagtttggccttgtgctcgtgaattatggctacaatgttaactgattctgtgattcaggcactgtgggagatgcctaagtttctaaaacctctgcgcataatgtttgtttggatgttaggaattgcattgaaaaattgcttttgtgatgttgatgttaataccaattacaagtgtgttcttcaacttctgcaataccttgttcgagtgagcttgagggggtttagattagtgtccaatgtgaaactagcaaatgaactccaagcgctgggataggtccttgggatggagcccctgatacccaagacagtattcaaaccctctaagtagagtgagagatcaaggaaagaaactgggtggttcctcaaatcgtaaaaaatgaatacagtgtcatgattgctaatcttatcacaaatcgtaaaaaatgaattatggtcgattttggactatttttgggtcattttgagtgaatctcaaacttaaaaagcgagtcttctagcagttcttgttacagcggggcatacataggtaggaatttggttttttactatttgagccttttgactgttgtggccggtaatatggaatagtctagcacttctgcgtgtgtacaactagtatttattgtaattatgtgatcgcacttaactctcagataaaaccttaagcactaacattttgttttggttgaaggaatcaggaggaaagaaaattgagggatttgttggtatatagattcctttgtttggataacaaaattggagtggagagatttggaaggaagaattttatagggattagttcccattacacttatgttgattacaaaatttctccaaaagtggaaagattttgagtgaaaatgttttttatttctcttcctctccctttctttccctcttaaacaaacaaggaaagttaatcttatcattccgtaccttccccttctgttct

SEQ ID NO: 14 - DNA, 2379 bp, Amaranthus palmeri
attattgtgtaattcttccctcacgtctctattgtcttcatttttttagaaaaataaataaagcttggttttatagattttgtaactgatatgcaatacatttgcgtttgctttcagttattgattcaaaaacaataatgctaaagccctaatcctaacatgttgtgtcatctgttgaaacaatacttgaaatcgctataaaaagggatttttgtcgggtacttcagttgttgaaattgatatggtcaagtacaattcattttaacccaatttgtaatgatttactggcttggtttcttagctgtttgttttaataaaggattttagttcggtatttggttgttgaaaaaattgatatggccaagtaatggtcatattaacacaattggtaatgttttattagctcaatagtgtttgttaagtatgtgactcaaatttaatcaagtataacttattgaagcgtagttcttttatccattaggtttggctctgtgtttgctggactaattcaatcaacattgttatctaagaaggaaaagggtggaggagaaaatgcttctatcaagaagcctcgtgtacgcggttcattttcattccatggtggaatgcaggtataaccttatagccataatttcgctttttataccttatacttccaaaatatattgatgcattttcttgctacaatcacaaaagctttgggaaaaattctcaattttgtcaaatctactaaaataattcattttggaaccaaggttttctatttcagaatacatggatgaagacatgcagtaagtatggataaaataatctagatgtaaaaggtttttagtctattaagcaagaatattataattcagagtcgtttcatcaataaagtgttgtttaagtgcagcaattacattctgcttcaagcaaaggctatcttaagacttaagaggctcccaaaacatgaggaggtatgagaccttagaggccaaagaaataaaatttgatgaggagacttggtgagataccttgcttccaaaaatgatatatttttccccttagacacctcagattatgacatttataaggtgtccctgcgtattcgacgagattttacgacctatactctaaagtctaaattgagtgagaaatgtgtatatgtgtaagaaaggaaagttagtaccatgaattccatgtctacgacctcaaagtgttcataccattgaaattagtgagcttacaattgttaagaaagcatcaactattcataattgatcattgatgaagtgtgtaatagacatgctaggtgaaattcgaaagggatctactctgtctttgagtttacaatttgcttctagtttttagctatttataggtgctatcaaagggttgaatattgttttttctgaacattgttgccgagttgtgaagggagaatgatggtagatttctcttaatgagaacattctcttcataaagagttcgatagcgcaaaaacgaaagcttattgccaaaagtggctggggtagatgaaagagaactgcaattgattttgctaggcttgactttgagtaaagaattcatggcataaggtagaaaaataggagatggctgaatgatatcgaaaccttttgattctttttgttttgtttgcaatgcacagaaaggcaggacgggaaagtgtgattaaatggatgggaaaaattgctagaatagaaaagaagaaagatgtagcactcacgtgaggaaattacccaatatctgaatggagctcacactcctctcttcctctactaatatacaacctgcctaatttgcacaatagctgctaatatcatagtagtatgagataatggctggatgtctcaattgttaccctagttttgacaactattttacgttggcatttcggtggcctggggccgtggactgagtcaccttaaaaattcatctgtgatatagtttagaatcaattttgaaaatttaggcaggcctaaattttgataaagatagcatgatctaaagaatgcagctctaataaatttacataaaatttgatattaagtagtctctgtctaggcctgccttccgagcttgtatattaactgagcgcatgtttatttgaggaatagcataggagtcatttttttgcatactaattagcatgtcaattttattccatttgctgagtactgtatgttctgcagacacttgttgacacaatgtgcaaacagcttggtgaagacgaactcaaactccagtgtgaggtgctgtccttgtcatacaaccagaaggggatcccttcattagggaattggtcagtctcttctatgtcaaataataccagtgaagatcaatcttatgatgctgtggttgtcactgtgagttttt

SEQ ID NO: 15 - DNA, 760 bp, Amaranthus palmeri
tcaaattggtcaaacccttaaacgatcaactaacgttttccattaagtggtagtcatttgcaaagaaatatattatattatgtagttttttacaaaaaaagaaaactacattaggcagttttttgcaaatagacctattagattttttttttaatttttccttcttgttatttgctgtttctaatgtggcttcaaaaatgaagtttggtaaccaaacttttcaaatttgaagtgagggttgggaagccttttggtgtcccttctattaagagttggggcctcacaatcactagataacgtgcctttctctcatgccttacctttctaattcttagaatagaaaaaagacggtgaattttttatacgctgtatgattacattttttgaaatctctccgatcatcttgatcatgggatggaattgttcgtgcacatgttttttaagaatggaatctaagcatagtgtattagagagaatgagtgaaagttagtggaaagaaaaattgagttggagaataaaataaaaaacaagtgggtaatagaaataagtggttacgatgaagagggtgtataaatttgtagataagattaaaaggggtgggagtaccattgttataaaagaaaagagtgcaaaatccgttggacgaatttaaataaaaagtggtgtaaaatgaaaggaacgacaagaatatgattttcccagctataacactgtcacaaatgtaattcatcaatatcttttcaacatttctctaataatt

SEQ ID NO: 16 - DNA, 1872 bp, Amaranthus rudis
gcgagagagatgagtgcgatggcgttatcgagcagcattctacaatgtccgccgcactccgacatctcgttccgcttttttgctcatacacgaacccaatcccccatcttcttcggaagaccacgaaaattatcatatatccattgttccacaagctcaagctcaactgccaattaccagaacaccattacgagccaaggagaaggagataaagtattagattgtgtaattgttggagctggtatcagtggactttgcattgctcaggctctttctaccaaacacattcaatccaatctcaatttcattgtcactgaagctaaacatcgtgttggaggtaatatcactaccatggagtccgatggctatatctgggaagagggtcctaatagtttccaaccctccgatcctgtgcttactatggcggttgacagtggattgaaagacgatttggtcttgggagatcctaatgcccctcgtttcgtgctctggaatggtaaattaaggcctgttccttccaaacctacggaccttcccttttttgatctcatgagctttcctggtaagattagggctggtcttggtgcacttggtcttcgtcctcctcctcctcctccttcttatgaggaatctgttgaagaatttgtgcgccgtaatctcggcgatgaggtcttcgaacgcttgatcgaacccttttgttctggtgtctatgctggtgatcctgcaaagttgagtatgaaagctgcatttggaaaggtctggaccttagagcaaaagggtggtagtatcatagccggtacactcaaaactattcaggaaaggaaaaataatcctctaccccctcgagacccccgccttcctaaacctaagggccagactgttggatcctttaggaaagggctcattatgttacctaccgccattgctgctaggcttggcagtaaagtcaaactatcgtggacactttctaatattgataagtcgctcaatggagaatacaatctcacttatcaaacacccgatggaccggtttctgttaggaccaaagcggttgtcatgaccgtcccttcgtacattgcaagtagcttgcttcgtccgctctcagatgttgctgcagattctctttctaaattttactatccaccagtcgcagcagtgtccctttcttatcccaaagaagcaattagaccagaatgcttgattgatggagaactaaaaggattcgggcaattgcatccccgcagccagggtgtggaaaccttgggtacaatttatagttcatctcttttccctggtcgagcaccacccggtaggaccttgatcttgagctacattggaggtgctacaaatcttggcatattacaaaagagtgaagatgaacttgcggagacagttgataaggatctcagaaaaattctgataaatccaaatgcgaaaggcagccgtgttctgggagtgagagtatggccaaaggcaatcccccaatttttagttggtcactttgatgtgctagatgctgcaaaagctggtttggcaaatgctgggctaaaggggttgtttcttggtggtaattatgtatcaggtgttgccttggggaggtgtatagagggtgcttatgactctgcttctgaggtagtggatttcctctcacagtacaaagataagtagtcaatagggctccagcatcttggttaagtaactttttgtagctgttgtaatttggaaagatgtaaaatagcccacactcaaacaagtttggaaagatgtaaaagcatgagatacagtcggtgttcattgagaggatagatgcaaataacttggacggaaaaaaaaagaaaaaaaaacaaaacatgtcggccgcctcggtctcta

SEQ ID NO: 17 - DNA, 1605 bp, Amaranthus rudis
atggtaattcaatccattacccacctttcaccaaaccttgcattgccatcgccattgtcagtttccaccaagaactacccagtagctgtaatgggcaacatttctgagcgggaagaacccacttctgctaaaagggttgctgttgttggtgctggagttagtggacttgctgctgcatataagctaaaatcccatggtttgagtgtgacattgtttgaagctgattctagagctggaggcaaacttaaaactgttaaaaaagatggttttatttgggatgagggggcaaatactatgacagaaagtgaggcagaggtctcgagtttgatcgatgatcttgggcttcgtgagaagcaacagttgccaatttcacaaaataaaagatacatagctagagacggtcttcctgtgctactaccttcaaatcccgctgcactactcacgagcaatatcctttcagcaaaatcaaagctgcaaattatgttggaaccatttctctggagaaaacacaatgctactgaactttctgatgagcatgttcaggaaagcgttggtgaattttttgagcgacattttgggaaagagtttgttgattatgttattgacccttttgttgcgggtacatgtggtggagatcctcaatcgctttccatgcaccatacatttccagaagtatggaatattgaaaaaaggtttggctctgtgtttgctggactaattcaatcaacattgttatctaagaaggaaaagggtggagaaaatgcttctattaagaagcctcgtgtacgtggttcattttcatttcaaggtggaatgcagacacttgttgacacaatgtgcaaacagcttggtgaagatgaactcaaactccagtgtgaggtgctgtccttgtcatataaccagaaggggatcccctcattagggaattggtcagtctcttctatgtcaaataataccagtgaagatcaatcttatgatgctgtggttgtcactgctccaattcgcaatgtcaaagaaatgaagattatgaaatttggaaatccattttcacttgactttattccagaggtgacgtacgtacccctttccgttatgattactgcattcaaaaaggataaagtgaagagacctcttgagggcttcggagttcttatcccctctaaagagcaacataatggactgaagactcttggtactttattttcctccatgatgtttcctgatcgtgctccatctgacatgtgtctctttactacatttgtcggaggaagcagaaatagaaaacttgcaaacgcttcaacggatgaattgaagcaaatagtttcttctgaccttcagcagctgttgggcactgaggacgaaccttcatttgtcaatcatctcttttggagcaacgcattcccattgtatggacacaattacgattctgttttgagagccatagacaagatggaaaaggatcttcctggatttttttatgcaggtaaccataagggtggactttcagtgggaaaagcgatggcctccggatgcaaggctgcggaacttgtaatatcctatctggactctcatatatacgtgaagatggatgagaagaccgcgtaa

SEQ ID NO: 18 - DNA, 1238 bp, Amaranthus rudis
gagagagtgcgagagagatgagtgcgatggcgttatcgagcagcattctacaatgtccgccgcactccgacatctcgttccgcttttttgctcatacacgaacccaatcccccatcttcttcggaagaccacgaaaattatcatatatccattgttccacaagctcaagctcaactgccaattaccagaacaccattacgagccaaggagaaggagataaagtattagattgtgtaattgttggagctggtatcagtggactttgcattgctcaggctctttctaccaaacacattcaatccaatctcaatttcattgtcactgaagctaaacatcgtgttggaggtaatatcactaccatggagtccgatggctatatctgggaagagggtcctaatagtttccaaccctccgatcctgtgcttactatggcggttgacagtggattgaaagacgatttggtcttgggagatcctaatgcccctcgtttcgtgctctggaatggtaaattaaggcctgttccttccaaacctacggaccttcccttttttgatctcatgagctttcctggtaagattagggctggtcttggtgcacttggtcttcgtcctcctcctcctcctccttcttatgaggaatctgttgaagaatttgtgcgccgtaatctcggcgatgaggtcttcgaacgcttgatcgaacccttttgttctggtgtctatgctggtgatcctgcaaagttgagtatgaaagctgcatttggaaaggtctggaccttagagcaaaagggtggtagtatcatcgccggtacactcaaaactattcaggaaaggaagaataatcctccaccccctcgagacccccgccttcctaaacctaagggccagactgttggatcctttaggaaagggctcattatgttacctaccgccattgctgctaggcttggcagtaaagtcaaactatcgtggacactttctaatattgataagtcgctcaatggtgaatacattctcacttatcaaacacccgatggaccggtttctgttaggaccaaagcggttgtcatgactgtcccttcatacattgcaagtagcctgcttcgtccgctctcagatgtttgtctgcagattctcttaattaattttccttttcacaattcgcttttacagggttttccttcacctacagaaacaccaaagttaagaaatctgattttaccctccaatttatctccctga

SEQ ID NO: 19 - DNA, 635 bp, Amaranthus rudis
ggccagggtgtggaaaccttgggaacaatttatagttcatctcttttccctggtcgagcaccacccggtaggaccttgatcttgagctacattggaggtgctacaaatcttggcatattacaaaagagtgaagatgaacttgcggagacagttgataaggatctcagaaaaattctgataaatccaaatgcgaaaggcagccgtgttctgggagtgagagtatggccaaaggcaatcccccaatttttagttggtcactttgatgtgctagatgctgcaaaagctggtttggcaaatgctgggctaaaggggttgtttcttggtggtaattatgtatcaggtgttgccttggggaggtgtatagagggtgcttatgactctgcttctgaggtagtggatttcctctcacagtacaaagataagtagtcaatagggctccagcatcttggttaagtaactttttgtagctgttgtaatttggaaagatgtaaaatagcccacactcaaacaagtttggaaagatgtaaaagcatgagatacagtcggtgttcattgagaggatagatgcaaataacttggacggaaaaaaaaaagaaaaaaaaacaaaacatgtcggccgcctcggtctctactga

SEQ ID NO: 20 - DNA, 5704 bp, Amaranthus rudis
attaagttttgatgtttttagctgcaataatttgttgatgaaaaagccactacttttttctcagctgcaaattatgttggaaccatttctctggagaaaacacaatgctactgaactttctgatgagcatgttcaggaaaggcaagtgccacatactattaagtgttagttgctgagaatatatttgaatctaagatgcacgaagaccactggtgcccttgctctatcaattctgatggaaaggattatcgctgaatttaccttctactaaaacatcgataaaatacttcattattagcatcaaaagattccctccatccttctggttttgctagacttgccttatgaaggtgttcaaggagtagtttgctacccttcaagatagggtagtggttgccgtctctcataatttcagtcactcgttttcctctcctaattcaagccataatttttatggttcctccacacaacacttgctaaatttgaaaagtagcaaagaggaagtgagcaaaatcagcaggagtaggactgatgagtaagagcttgattaagtgtagaggattttcttttgtgttgaatatgaatgcatcatgcatgactgtagaattgacataatgatttgtctgcagcgttggtgaattttttgagcgacattttgggaaagaggtattgttgccaattgccatgctctattcattccggtgaattaacaaatgttgtgcttctgcttactattgcttataattattgtttgttgcagtttgttgattatgttattgacccttttgttgcgggtacatgtggtggagatcctcaatcgctttccgtgagttaaatactgtgcttgcttttttttttttcaacattttctggaggctgtaaataaattatactcctttctattctaatcaaatatcctatttccccttttggcatattcaaatttagttaaatattgtgtaaattatttacacaattgccattaaattttcacttttcccttactcactcttctcatgtgtcccttcccccttttcttaaaattggtgcattatcaaataggacatttgatttgaataggcgggagtttccaattgtgcttccaaaggtagcttgtcactttttctttttctttaaattttgtaccatgccatgcattttgaacctcaactcatttcgccataaaggaatattatgtttgagaagaacgaggatactattatcttatagataacatataggtttcattatcaatgattgtttgattttcaactcttcttttcctttcatgctcatattgatgttatttctatttgttatgaattatgtccattgtgttaatgtctttctttattgtagatgcaccatacatttccagaagtatggaatattgaaaaaaggtatgaaccttaaagctttaattttcttcgaacttaatgtttcttaattgattcttttggatcaatttccataagaatggaaatttaaaaaagggtatgaaccttaaagatttcttcgaacttatatgttttgtaattcatgcttttagatgctgcaccattttatctatgtgtcttaagtttgttgtaatcatttgtagaccaaaagaatgaatggtctggtttgaaatggttcatcgtgcaaaaatgcgattttgcttgtgattgaggtaacattcaaggtggtgtgtttgtcgtactgtcaaatgtcttcctataccatgtgatatatatataagcctaaaatgatatattgtacacctttaggatgtggatagcaggggttcagtacatatgaaaaatccttgcaatttgatctgtacgatcaatgtgattttgccttttgccttttgccttttgttatatgatgatgattccatgtgaaattttgggatttagaaaattcacttgtttaagaacatttgaatcaaactttcaccaatttcaaccacatttaattgcggcaaagccgaactttaaaagtcactcccaatctttgagatatccaaactccaaaacttctattagctttcatgttttcaccaagtaaagttggtgcgactccttaccattttctttattatgcatttcgttgatgtataatagtatagattggtgctctctttgctctccttccaacatgcataacttctagttcttgtcgttttcttttcctccctatttttatttgacttgtagctatttttgttcactcttctcgcccaatccatagctaaagaaacttgatttcattgattttgtaactgatatgcaattcatttttgtttgcttttagttgttgattcaaaaacaataatgctaaagccctaatcctaacatgtcgggttagctgttgaaacaatacttgaaattgctataaaaagggattttttttcgggtacttcagttgttgagattgatatggtcaagtataatttgttttaacacaatttgtaatgatttaatggcttagtttcatagctgtttgtattaataaaggaaggaggactatctgaaattgcaataggaaagagattttagttcggtatttggttgtttaaattgatatggccaagtaatgttcattttacacaattggtaatgttttattggctcaatagtgtttgtaagtatgcgactcaaatttaatcaagtataacttattgaaacataaataaatatccattaggtttggctctgtgtttgctggactaattcaatcaacattgttatctaagaaggaaaagggtggagaaaatgcttctattaagaagcctcgtgtacgtggttcattttcatttcaaggtggaatgcaggtataaacttgtagccataatttcactttttataccttatacttccaaaatatattgatgcgtttttcttgctacaaagtacaaacacaaaagctttgggaataattctcaattttgtcaaatctactaaaaatattctattaggaatcaaggtttctattttagaatatatggatgaagacatgtagaagtgtgaataaaaaaacctagatgtgaaaggtttttagtctattaaacaagaatattagaattcagagtcgtttcatcaataaaatattgttgaagaggagcaattacattctgcttcaagcaaaggcaatcttaagaggaccctaaaacttgaggaggtatgagaacttagaggccaaagaaattaaatttgatgaagagatttggtgagataccttgcttacaaaaatgattaattttccccttagacacctcaaattatgacatttataagttctccatgcgtattcgacaagatgttacatcctatattctaaattaagtatgaaatttgtatatgtgtaagaaagaaaagttagtcccttgaattccatgtctacgacctcaaagtgttcataccattgaaattagcgagcttacgattgttaagaaaggatcaacttgtcatcattgatcattgatgaagtgtgtaatagacatactaggtgaaattcaaaagggatctactcagtctttgagtttaccgtttgcttctagtattttgctatttataggcactatcaaagggttcaatattgttttttctgaacattgttgccgaattgtgaagggagaatgatggtagatttctcttatttttatgagaaaattctctttataaagagttcgatagctcaaaaatgaaagcttattgccaaaagtggatggggtagatgaaggagaaatgcaatcaattttggtaggcttgactttgagtaaagaatttgtggaataaggtagaaaaataggatttggctgcatgatattgaaaccttttgctacttttctttttgttttggttgcaatgcacagaaaggcaggacggtaaagtgtgataaaatggatgggaaaaattgctagaatagaatagaagaaaaataatggcaggatgtatcctttgttaccctagtttcgacaactgtgttacgtcggtattatcggtggcttggactgagtcatcatagaaattcttctctgatatagtttagatgaaatttttaaaatttaagcaggcctgaattttgataaagatagcatgatctaaagaaggcagctctaataaatcaacataaaatttgatattaagtagtctctgtctaggcctgctttccgagctagtatattaactgagtacatgttattagagcaatagcataggagtcatgtttttgcatactgattagcatgtcaattttattccatttgctgagtactgtatgttctgcagacacttgttgacacaatgtgcaaacagcttggtgaagatgaactcaaactccagtgtgaggtgctgtccttgtcatataaccagaaggggatcccctcattagggaattggtcagtctcttctatgtcaaataataccagtgaagatcaatcttatgatgctgtggttgtcactgtgagtttttgtctacttttgtctctatgagcatgcaattcctttcacagccgttgagttagcaattatattccagtttgaaacttaaagttttttgggggaatttttctagcattcaagtcaatcaaggcttatttggaactcaaagctttatctatgttatatgaaactacaataaaatgatttctaaaaaattaattgcgaatagcggagattcaattagggtgtataattgatccacatcaaatagcatgcattctacatgttagtcacttgtggcttctctagtcctctgtctccagaaaaagcctgcatacaaaggctcatgaagactagtatgctatatactttccgaaatgtcagcattaagtaacttgtgttgaggaaatatgtaaatcgtaccctgttaccctctttttaaagagtgattttttttttaattgaatgtggttatagctatctggtttgatgaagatttaccattcttaatgaagcaaaaaattttaagttcacaagtttcaattatattaggcatttaggctgctatacagtgaattggctcgataaattttgcgcatgtcttatttatgtgaattgtagataacgtttgctacaaagggtcaatcaagaacaaccttttcatttttgtaaggataactcctaaattctgcctaggttggaggatatgtggaagtcacttaatggcaataggactgaaatattgttgaatatggttatctagtaccaattcacacttgtatacatgagtacatgtctaatgctctttgttgtgatttacttaaacaagaattatgttcattagcaggctttcatgctctctgtacagcaccttatctttcctttaccacgatactatttgtcttgtttaattatacatatatcataaatgtttcgacattcggtctaaaatattttggatgggtgtatactgtttaatgcaacaatatgtaaaatagatacataaagaaaagtaaaaggaataatgaattacaaaaaatacgatgaaaattgaaaatggatgttgtatttcaaaaggaggttaaaggagtgatttgcttccaaagtagaaatcattccgagttcgtagattgttttaagaataccgagtgtagtatggattatggtggacaaaattttctataatattttttcataaacaatagtgaagcaaaaaattattggcgaaacaggtgtcagcttaaaatttccttttcacatggttattttcgtcatagctc

SEQ ID NO: 21 - DNA, 1031 bp, Amaranthus rudis
ttttaaccaatcctcaaaatttacaccatggagatgtctgcggataagaattagtaactgtagcagctgtaattgttgcatgcagttttatggtttgccttgcaattcaaacttgggatattgtttgccttgcaatttgtagtttagtgtttgcccttcactttgtattttagttatttttttcattgcaatttgctctttgaagtataaaatggtgacctttcttgctcaggatgttgctgcagattctctttctaaattttactatccaccagtcgcagcagtgtccctttcttatcccaaagaagcaattagaccagaatgcttgatcgatggagaactaaaaggattcgggcaattgcatccccgcagccagggtgtggaaaccttgggtatatgctcccattcaactatatctcaataattatgagtatttttctttctctggattattcaatttggtgacgttaaattttgactgtactcgacaggaacaatttatagttcatctcttttccctggtcgagcaccacccggtaggaccttgatcttgagctacattggaggtgctacaaatcttggcatattacaaaaggcaagtcatttatacaattatatgtgtccttgtatcctcaaataagtcgtatcaatcctgacgacatgcttctatcaatgcagagtgaagatgaacttgcggagacagttgataaggatctcagaaaaattctgataaatccaaatgcgaaaggcagccgtgttctgggagtgagagtatggccaaaggcaatcccccaatttttagttggtcactttgatctgctagatgctgcaaaagctggtttggcaaatgctgggctaaaggggttgtttcttggtggtaattatgtatcaggtgttgccttggggaggtgtatagagggtgcttatgactctgcttctgaggtagtggatttcctctcacagtacaaagataagtagtccatagggctccagcatcttggttaagtaactttttgtagctgttgtaattt

SEQ ID NO: 22 - DNA, 1017 bp, Amaranthus rudis
agagagtgcgagagagatgagtgcgatggcgttatcgagcagcattctacaatgtccgccgcactccgacatctcgttccgcttttttgctcatacacgaacccaatcccccatcttcttcggaagaccacgaaaattatcatatatccattgttccacaagctcaagctcaactgccaattaccagaacaccattacgagccaaggagaaggagataaagtattagattgtgtaattgttggagctggtatcagtggactttgcattgctcaggctctttctaccaaacacattcaatccaatctcaatttcattgtcactgaagctaaacatcgtgttggaggtaatatcactaccatggagtccgatggctatatctgggaagagggtcctaatagtttccaaccctccgatcctgtgcttactatggcggtaaactgattcttctctctttctccaatttttgatcattctattcaattttccccttattgaatcaaaatcaaattccaggttgacagtggattaaaagacgatttggtcttgggagatcctaatgcccctcgtttcgtgctctggaatggtaaattaaggcctgttccttccaaacctacggaccttcccttttttgatctcatgagctttcctggtaagattagggctggtcttggtgcacttggtcttcgtcctcctcctcctcctccttcttatgaggaatctgttgaagaatttgtgcgccgtaatctcggcgatgaggtcttcgaacgcttgatcgaacccttttgttctggtacctaccctgtttaatttttcaattttcccccttttttctctactactactttattgattcttatccatgagtgtactatgggagttgacaataattgttcaggtgtctatgctggtgatcctgcaaagttgagtatgaaagctgcatttggaaaggtctggaccttagagcaaaagggtggtagtatcatagccggtacactcaaaactattcaggaaaggaa

SEQ ID NO: 23 - DNA, 630 bp, Amaranthus rudis
  unsure (1)..(630): unsure at all n locations
gtcttgggagatcctaatgcccctcgtttcgtgctctggaatggtaaattaaggcctgttccttccaaacctacggaccttcccttttttgatctcatgagctttcctggtaagattagggctggtcttggtgcacttggtcttcgtcctcctcctcctcctccttcttatgaggaatctgttgaagaatttgtgcgccgtaatctcggcgatgaggtcttcgaacgcttgatcgaacccttttgttctggtacctaccctgtttaattttntcaggtgtctatgctggtgatcctgcaaagttgagtatgaaagctgcatttggaaaggtctggaccttagagcaaaagggtggtagtatcatagccggtacactcaaaactattcaggaaaggaaaaataatcctccaccccctcgagacccgtccgtaatcaccattacttattgctttccatcaccttgaatcttaccttaatatacatgtatttaattgataatgtcacattgcctcatttgcagccgccttcctaaacctaagggccagactgttggatcctttaggaaagggctcattatgttacctaccgccattgctgctaggtatcttttgactctcaaaccttatatat

SEQ ID NO: 24 - DNA, 612 bp, Amaranthus rudis
acactcaaaactattcaggaaaggaaaaataatcctccaccccctcgagacccgtccgtaatcaccattacttattgctttccatcaccttgaatcttaccttaatatacatgtatttaattgataatgtcacattgcctcatttgcagccgccttcctaaacctaagggccagactgttggatcctttaggaaagggctcattatgttacctaccgccattgctgctaggtatcttttgactctcaaaccttatatatttctcatcttctccttctgccagtgccatactaatactagtatctttaccatatattttttatttttttaggcttggcagtaaagtcaaactatcgtggacactttctaatattgataagtcgctcaatggagaatacaatctcacttatcaaacacccgatggaccggtttctgttaggaccaaagcggttgtcatgaccgtcccttcgtacattgcaagtagcttgcttcgtccgctctcagtgagtatcattctttccttcatttctattcttttaatgctatccaatgtcttattaagcactagtttggcgttgtgctcatcaactatgactataatgttaactaatag

SEQ ID NO: 25 - DNA, 487 bp, Amaranthus rudis
ttgatttgaagataggataaccagagagagtgcgagagagatgagtgcgatggcgttatcgagcagcattctacaatgtccgccgcactccgacatctcgttccgcttttttgctcatacacgaacccaatcccccatcttcttcggaagaccacgaaaattatcatatatccattgttccacaagctcaagctcaactgccaattaccagaacaccattacgagccaaggagaaggagataaagtattagattgtgtaattgttggagctggtatcagtggactttgcattgctcaggctctttctaccaaacacattcaatccaatctcaatttcattgtcactgaagctaaacatcgtgttggaggtaatatcactaccatggagtccgatggctatatctgggaagagggtcctaatagtttccaaccctccgatcctgtgcttactatggcggtaaactgattcttctctctttctccaatt

SEQ ID NO: 26 - DNA, 1582 bp, Amaranthus spinosus
agagagagtgcaagagagatgagtgccatggcgttatcgagcagcattctacaatgtccgccgcactccgacttctctttccgcttttctgcttatacaccaacccgctcccccttcttcttcggaagacctccaaaattatcatatatccattgttccacaagctcaagctcaactgccaattaccagaacacgattacgacccaaggagaaggagataaagtattggattgtgtaattgttggagctggtatcagtggactttgcattgctcaagctctttctaccaaacacattcaatccaatctcaatttcattgtcactgaagctaaaaaccgtgttggaggtaatatcactaccatggagtccgatggctatatctgggaagagggtcctaatagtttccaaccctccgatcctgtgcttactatggcggttgacagtggattgaaagatgatttggtcttgggagatcctaatgcccctcgtttcgtgctctggaatggtaaattaaggcctgttccttccaaacctacggaccttcccttttttgatctcatgagctttcctggtaagattagggctggtcttggtgctcttggtcttcgtcctcctcctccttcttatgaggagtctgttgaagaatttgtgcgccgtaatctcggtgatgaggttttcgaacgcttgattgaacccttttgttctggtgtgtatgctggtgatccttcaaagttgagtatgaaagctgcatttggaaaggtctggaccttagagcaaaagggtggtagtatcatcgccggtacactcaaaactattcaggaaaggaagaataatcctccaccgcctcgagacccccgccttcctaaacctaagggccagactgttggatcctttaggaaagggctcattatgttacctaccgccattgctgctaggcttggcagtaaagtcaaactatcatggacactttctaatattgataagtcgctcaatggtgaatacaatctcacttatcaaacacccgatggaccggtttctgttaggaccaaagcggttgtcatgactgtcccttcatacattgcaagtagcctgcttcgtccgctctcagatgttgctgcagattctctttctaaattttactatccaccagtcgcagcagtgtccctttcttatcccaaagaagcaattagaccagaatgcttgatcgatggagaactaaaaggattcgggcaattgcatccccgcagccagggtgtggaaaccttgggaacaatttatagttcatctcttttccctggtcgagcaccacccggtaggaccttgatcttgagctacattggaggtgctacaaatgttggcatattacaaaagagtgaagatgaacttgcggagacagttgacaaggatctcagaaaaattctgataaatccaaatgcgaaaggcagccgggttctgggagtgagagtatggccaaaggcaatcccccaatttttagtaggtcactttgatctactagatgctgcaaaagctggtttggcaaatgctgggctaaaggggttgtttcttggtggtaattatgtat

SEQ ID NO: 27 - DNA, 1485 bp, Amaranthus thunbergii
agagagtgcgagagaaatgagtgcgatggcgttatcgagcagcattctacaatgtccgccgcactccgacatctcgttccgcttttctgctcattcaccaacccactcccccatcttcttcggaagaccacgaaaattatcatatatccattgttccacaagctcaagctcaactgccaattaccagaacacgattacgacccaaggagaaggagataaagtattagattgtgtaattgttggagctggtatcagtggactttgcattgcgcaggctctttctaccaaacacattcaatccaatctcaatttcattgtcactgaagctaaacatcgtgttggaggtaatatcactaccatggagtccgatggctatatctgggaagagggtcctaatagtttccaaccctctgatcctgtgcttactatggcggttgacagtggattgaaagacgatttggtcttgggagatcctaatgcccctcgtttcgtgctctggaatggtaaattaaggcctgttccttccaaacctacggaccttcccttttttgatctcatgagctttcctggtaagattagggctggtcttggtgcacttggtcttcgtcgtcctcctcctccttcttcttatgaggaatctgttgaagaatttgtgcgccgtaatctcggcgatgaggtcttcgaacgcttgatcgaacccttttgttctggtgtgtatgctggtgatcctacaaagttgagtatgaaagctgcatttggaaaggtctggaccttagagcaaaagggtggtagtatcatcgccggtacactcaaaactattcaggaaaggaagaataatcctccaccccctcgagacccccgccttcctaaacctaagggccagactgttggatcctttaggaaagggctcattatgttacctaccgccattgctgctaggcttggcagtaaagtcaaactatcgtggacactttctaatattgataagtcgctcaatggtgaatacattctcacttatcaaacacccgatggaccggtttctgttaggaccaaagcggttgtcatgactgtcccttcatacattgcaagtagcctgcttcgtccgctctcagatgttgctgcagattctctttctaagttttactatccaccagtcgcagcagtgtccctttcttatcccaaagaagcaattagaccagaatgcttgatcgatggagaactaaaaggattcgggcaattgcatccccgcagccagggtgtggaaaccttgggaacaatttatagttcatctcttttccctggtcgagcaccacccggtaggaccttgatcttgagctacattggaggtgctacaaatgttggaatattacaaaagagtgaagatgaacttgcggagacagttgataaggatctcagaaaaattctgataaatccaaatgcgaaaggcagccgtgttctgggagtgagagtatggccaaaggcaat

SEQ ID NO: 28 - DNA, 1808 bp, Amaranthus viridis
ggataaccagagagagtgcgagagaaatgagtgcgatggcgttatcgagcagcattctacaatgtccgccgcactccgacatctcgttccgcttttctgctcattcaccaacccactcccccatcttcttcggaagaccacgaaaattatcatatatccattgttccacaagctcaagctcaactgccaattaccagaacacgattacgacccaaggagaaggagataaagtattagattgtgtaattgttggagctggtatcagtggactttgcattgcgcaggctctttctaccaaacacattcaatccaatctcaatttcattgtcactgaagctaaacatcgtgttggaggtaatattactaccatggagtccgatggctatatctgggaagagggtcctaatagtttccaaccctctgatcctgtgcttactatggcggttgacagtggattgaaagacgatttggtcttgggagatcctaatgcccctcgtttcgtgctctggaatggtaaattaaggcctgttccttccaaacctacggaccttcccttttttgatctcatgagctttcctggtaagattagggctggtcttggtgcacttggtcttcgtcgtcctcctcctccttcttcttatgaggaatctgttgaagaatttgtgcgccgtaatctcggcgatgaggtcttcgaacgcttgatcgaacccttttgttctggtgtgtatgctggtgatcctacaaagttgagtatgaaagctgcatttggaaaggtctggaccttagagcaaaagggtggtagtatcatcgccggtacactcaaaactattcaggaaaggaagaataatcctccaccccctcgagacccccgccttcctaaacctaagggccagactgttggatcctttaggaaagggctcattatgttacctaccgccattgctgctaggcttggcagtaaagtcaaactatcgtggacactttctaatattgataagtcgctcaatggtgaatacaatctcacttatcaaacacccgatggaccggtttctgttaggaccaaagcggttgtcatgactgtcccttcatacattgcaagtagcctgcttcgtccgctctcagatgttgctgcagattctctttctaagttttactatccaccagtcgcagcagtgtccctttcttatcccaaagaagcaattagaccagaatgcttgatcgatggagaactaaaaggattcgggcaattgcatccccgcagccagggtgtggaaaccttgggaacaatttatagttcatctcttttccctggtcgagcaccacccggtaggaccttgatcttgagctacattggaggtgctacaaatgttggaatattacaaaagagtgaagatgaacttgcggagacagttgataaggatctcagaaaaattctgataaatccaaatgcgaaaggcagccgtgttctgggagtgagagtatggccaaaggcaatcccccaatttttagttggtcactttgatctgctagatgctgcaaaagctggtttggcaaatgctgggctaaaggggttgtttcttggtggtaattatgtatcaggtgttgccttggggaggtgtatagagggtgcttatgactctgcatctcaggtagtggatttcctctcacagtacaaagacaagtagtcaatagggctccaccttcctggttaactaacttttgtagctcttgtaatttgtatcatgtaatattattcagatgtaaaagatacagtcggtatttattgagaggatagatgcaaataactt

SEQ ID NO: 29 - DNA, 1829 bp, Ambrosia trifida
ggaacatcaaccagataagactttcccccaataaaaatgtcatctctcacaaacctcccttccctgaaccactaccgcacctggtcttccccacccattccccatcgaacccaatcatccaaaccccctaaccacctaaccacctatggtcccaccaataacaaccacaacagacgtacaacaacaaccttccgttgctcaatagccaacgacactccaatctctcctccaattaccaacgactccaattctaaacccttactggactgtgttattattggtgctggaatcagtggtctctgcattgcccaagccctagctactaaacatgctgacgtgtcacctgatgtggttgttacggaagcacgtgatagggttggaggtaatatatcgacggttgaacgtgatggatatttgtgggaagaaggtccgaatagttttcaaccgtctgatccgatgctcactatggtggtggatagtgggttgaaagatgatttggttttaggggaccccactgcaccacggtttgtattgtggggtggtggtttgaagccagtgccttccagtccagctgatttgcctttctttgatctaatgagctttactggaaaactcagagccggttttggtgctctagggatccgccctccaccaccagatcgtgaggaatctgttgaagaatttgttcggcgtaaccttggtgatgaagtttttgaacgcttaatagaaccattttgttcaggtgtttatgctggcgacccatcaaaacttagtatgaaagcagcatttggtaaagtttggaagctggagaagaatggtggtagcattattggtggagcattcaaagcaatccaagcaaaaataagagtaccaagcctcctcgggacccgagattaccaacaccaaagggccaaactgttggatcttttaggaagggacaagccatgttgcccaatgccatctcaaaacgtttgggtagcagagtgaaagtgtcatggaagctaataaatatctcaaagttggagaatagaggttataatctgacttacgaaacaccaaatggatttgcaagtctgcaaactaaaactgttgtcatgactgttccttcctacgtggcgagtgacttgttgcgtcctctttcgtcggaagcagcagaggctttgtccaaattttattaccctccagttgctgctgtatctgtttcctatccaaaagaagcgattcgtgctgaccgtttgatcgatggtcaacttaagggttttggtcaattacatccaagaagtcaaggcgttgagactttaggtaccatctatagctcatcccttttccctaaccgggcgccacctggaagggttctcctccttaactacattggaggggctacaaatcctggtattttgtcgaagacggagagtgaacttgtggaagcagttgaccgtgacctaaggaagatgctcataaaccctagagcaggcgaaccgttgactttgggggtcaaagtgtggcctcgagcaatcccacagtttctaattggtcattttgacattttggatgctgcaaaatttgctcttagtgaaggtggatatagaggtatgtttcttggaggcaactatgtttctggtgtggctttaggtcgatgcgtggagagtgcttatgacgttgcagccgatgtaagtacatttttgtcacgaggcgtgtataagtgatactgttatgtagcactttggaatactttcttgtgaggttagtggttacctttttgtcacaaggcaggtacaaataacaagccaattattggagttcaataataataatttttgtgtaggtta

SEQ ID NO: 30 - DNA, 921 bp, Ambrosia trifida
gactgacagagaaaccaacaatggcttcaccaactatagttgacaaccaaaaacctgctaagagagttgctgttgttggtgctggtgtcagtggttgtgctgctgcttataagttaaagttacatggattgaatgtgactgtgtttgaagctgatgggagcgttggtgggaaactaaagagcgtttcgcaagatggtttaatatgggatgagggtgccaatactatgactgagagtgaggcagatgttagcagtttgattgatgatcttgggcttcgagataaacagcagtttccaatttcacagcacaagcggtacattgtaagaaatggaaaacctgtattgataccttctaacccaattgcactgattagcagcagttttctttccactcagtcaaaggttcaaattcttttagagccatttttatggaagaagactaagtcatctgacgaacccgagagtgttggaggattctttcaacgtcattttgggaaggaggttgttgagtatctcattgatccagttgttgcgggaacaagcggtggagatcctgaatcactctctatgcgtcatgcatttcctgagctatgggatttagagagaaggtttggttcaatcatttctggggcatttcaatctatggtatcttccagaggtgggaaaaggaaaccttctggaaacagcaaacgtaggcgtggttccttttctttttttggtgggatgcagacactcactgatgcactatgcaaagagattggaccccatgaagttaatcttcaatcaaaggtgcttgaaatgtcctacagctgcgatgataatgcggttggtaattggtcaatttattgtgctccagatcaaaacaaacaatttcagcaatcttttgatgctgtgatcatgactgccccacttaacaacctgc

SEQ ID NO: 31 - DNA, 811 bp, Ambrosia trifida
tttctagcaatcttttgatgctgtgatcatgactgccccacttaacaatgtaaaagaaatgaagattacaaagacaggaagtccgtttctgcttaattttattccagaggtgagttatttgccaatatcagtaataatctccactttcaagaaagaaaacgtgaagcagcctcttgagggttttggagttcttgttcctgccaaggagcaggaaaatggtttgaggacactaggcaccctcttctcttccatgatgtttccagatcgggcctcagaagacgtgtacctttacaccacctttgttgggggtagtcgaaacaaagaactggccaaagcttcgagggacgagttgaagcagatagtaacttctgacctcagacagttgcttggaacagaaggggagccaaaatttctaactcactattattggagcaaagcatttccattgtatgggcgtgactatggttcagttattgaagcaattgagaagatggaaaaagagctacccggttacttttatgcaggtaaccacaaaggagggctctctgttgggaaagcaatatcctccggatgcaaagcagccgaatccgtgattgcatatttggattcttattcggaccagaagtagaaggatgggtgttgctagatgatgttttaactggattggccggagaatgtagatcaaaagagtttttgttcgctagagcgaggataaatttgacgaaaattcagcatggcttttcgttttgtgtttttgaaggtgagcaaggatggtgttgtataaacttattgttgagtaaattataactaa

SEQ ID NO: 32 - DNA, 4915 bp, Ambrosia trifida
cgcacgcaatggttttgcacttttgcccacagtaaagaaaaggtagcctctctacccgacccgacccgacccgaaccaaaccgataaaaacaaataccaactctgataaccagattactcacagagaaaccaacaatggcttcaccaactatagttgacaaccaaagttagggttcttctaaattctaattacattttatcctaattttacttacacatttgtagcatttgcatctataattcagaaacctaatctaatttattaattaattaattaagtggttttgttttctctacagaacctgctaagagagttgctgttgttggtgctggtgtcaggtacttaaacttaaaacctaaaacagataattattttgcttatttactagattcacttattctgttcatgtaatttgctaaggtttgatcagtcaattatatacatttagggatttaggagttacagaatgttttgatataataatatatacaatttgtaaaaatatatagatcatgattgataattagaggaatggaatattttgataattgaaaaaacaatatgttacatttttttcagtggttgtgctgctgcttataagttaaagttacatggattgaatgtgactgtgtttgaagctgatgggagcgttggtgggaaactaaagagcgtttcgcaagatggtttaatatgggatgagggtgccaatactatggtatgttttagtataatatgattggtttcactttgttagcattttttatgaggtttgttgtatgtgttaccttatgtagactgagagtgaggcagatgttagcagtttgattgatgatcttgggcttcgagataaacagcagtttgtaagttgttgtgtttgatatagctgccatacttcctatagcttgtgtggtaaattatatctatgaacatatgcaattattttgtaaaatgacaagaaacagattctttgttttatttgtgtatgaataatgaatagataagactaaattcatttttaggtctgcttcgatttgtcttttataatcactacgctgagttttaaatctttaacattatttcctgttgcagccaatttcacagcacaagcggtacattgtaagaaatggaaaacctgtattggtatggatatctcaacaccacttaactagtgatcctctatttttagtaaaattcatttactaaaaaaaggggggctgaaaaattaaaatttaatgtgaattgtgctttattaggtttgaatgcttaacctcatcaaagtcaaataataacatgagtagtctgttgctctggaaacccgtattgcaacccatgaaaagatccaaatcacggtttttcaaacactgttttatacttttatgtccagggaacaaaaaaccaaaatctttcctgagtgaggccttagttgtcttcttattatttatcttttatatttatcaagttcatgtctctctatattgaccatgactcagtctatatcatgattgcagataccttctaacccaattgcactgattagcagcagttttctttccactcagtcaaaggtatgttagtagctcctgccaccttgaaggttcaagcataagtatgccatatcttattgagatcgttcactcgcatactatcttcttaatgttgttcaatgttgagattaaagtgcaatctttattctattttgcttaatcaaatataatgtttatttattttaattttattaaaaaagtatctacgtaagtattacaaaaagtaaaaactcttccccgttgatgagatgatctcaaagtctaatgtcatatatctagtactctcaataagctaacataaacagtatagtctattaaaagggtccccaacatcgaaatgagtaacgctgctttgagttaagggtgcaaaatgtcatataataaataaagatgttctatgatgctttgatatttgtttcgcactttcacttatcccccatggtatttttaacttgtttttaaaagtagaagattttttttattgatgtgcatgcgattattatcggctttgtttgcaaattttacaggttcaaattcttttagagccatttttatggaagaagactaagtcatctgacgaacccgagaggtaaaatacatagccttgttccatttcatcggcttgaagtagttatattcggtacatgccattaggttcttaaccatgtattttgcagtgttggaggattctttcaacgtcattttgggaaggaggtgtttgtatattcgacataatgttttgtttctgttctgattctgtttctcatagttattaatatttgacctgcttatctaaggttgttgagtatctcattgatccagttgttgcgggaacaagcggtggagatcctgaatcactctctgtgagtaactattgtttctccacacatttttttggagaaatatacattgctgctttacattaacgaccttaaaccgtttaatatattgcttgaattcttttacttttccacacagatgcgtcatgcatttcctgagctatgggatttagagagaaggtatgtttgtaacaaacagtagtaattcttcttcaaacgatctgtggaataatgacttttgaccacttatttctgaagacctaaaatcaatttaatacttacaactatttaattcaggtttggttcaatcatttctggggcatttcaatctatggtatcttccagaggtgggaaaaggaaaccttctggaaacagcaaacgtaggcgtggttccttttctttttttggtgggatgcaggtaagacgagggtgatttactgatttagataagaccctaaatttagttattgttatcttttaattaattacagatgttatttgggtcgttcatgcttttttgctatgcagacactcactgatgcactatgcaaagagattggaccccatgaagttaatcttcaatcaaaggtgcttgaaatgtcctacagctgcgatgataatgcggttggtaattggtcaatttattgtgctccagatcaaaacaaacaatttcagcaatcttttgatgctgtgatcatgactgtgagtgccttcattgggtaatcttttacttatcagtgacataaagttagttaatttcttgcattcttgatgaagatagttttttgtatctttaaagtttattctgtgtcctctaggtagtatctggatattaatacatgggatgggaatttttttaatcttgagtttttctctgatggttattaagtgttagatgcatctaattttaactgacaaagaaaatattccccaattaggccccacttaacaatgtaaaagaaatgaagattacaaagacaggaagtccgtttctgcttaattttattccagaggtatgtttttttttcttctactaaagcattagttttagttctatcaaatctaacactgaatacagaaaacagctttaacatcgtcatccaattaaattgtgaaatatttatagtgtcatttcttagccttttgtttttataatacaggtgagttatttgccattatcagtaataatctccactttcaagaaagaaaacgtgaagcagcctcttgagggttttggagttcttgttcctgccaaggagcaggaaaatggtttgaggacactaggtgaagcttgattctgccctccattattgttttttatttgtttacattgacaccatagcaaaaattctgctatgcaggcaccctcttctcttccatgatgtttccagatcgggcctcagaagacgtgtacctttacaccacctttgttgggggtagtcgaaacaaagaactggccaaagcttcgaggtaggcaggcttgctcatcaccatattcccccttaaaattgtagtgtgaacttaactcaagttctaattaattttttgtgcatatgttcaaaatctatgatagccttctgaaagacaaagtaaaaaaagtctttactgattaattgtggtaaaatcaatttattcataatgacgttaattgacaaataggtcttggaaactttcctagtagaggatatgttgtaacttttaactcaaaaatctttcttgcaaaatagggacgagttgaagcagatagtaacttctgacctcagacagttgcttggaacagaaggggagccaaaatttctaacgtaagggcacaacgctatttcagtttaacagtaatctttgctagaataagaaatgtaaccgcttgcctacctatggtctttttatctgttaaacaaaattttgtttaataaccactagcctggtgtagtggcaaaggtgtatctccctcatccaagaggtgttgggttctagtctcacttgagacaaggggaacattataagcggagtaaaaaattagccgtttaaaaaaaaaaaagtttgtaatttgaagttttccatcatgaactgaaacagttgctaaaatgtaacaagaagttattaaagtcttgaggtacatagatatatacacaatgtaaatatggcttacggagttgtgaggttgattgcagtcactattattggagcaaagcatttccattgtatgggcgtgactatggttcagttattgaagcaattgagaagatggaaaaagagctacccggttacttttatgcaggtaacatgttttgtcttgaaaataaaaatggacaaatcatatgttgatgagtagaggtggcaattttgacctattataacttacagagggatagatactgccatactggttacgtatttctttaatgggtcacacgggtagaaataaaaatatagctcgggtcaaaagaagcctaaagtttattctgagcatacaacttcctagtcgtcgtatttcagaaattaaattcttatgttaataagataattttggt

SEQ ID NO: 33 - DNA, 851 bp, Ambrosia trifida
ttgcgcctcggttttggacctcgtcgctttagtgcgcttcgcgctttttaaaaccaagcttctatcgagtttaatgactaaaatttagtaaaatataatgaccaatatggaaggtatttcatgacaattaaccctaaatatattaggtaaccacaaaggagggctctctgttgggaaagcaatatcctccggatgcaaagcagccgaatccgtgattgcatatttggattcttattcggaccagaagtagaaggatgggtgttgctagatgatgttttaactggtaaactttatttcttatatcttattttttttcttatttttcaatgcaaagagtcaaacggcgcaagtgtaatatcaggattggccggagaatgtagatcaaaagagtttttgttcgctcgaggttggataaatttgacgaaaattcagcatggcttttcgctttgtgtttttgaaggtgagcaaggatggtgttgtataaacttattgttgagtaaattataactaatgacatgtttgaataatgtgttagaaaaaaatgaatcttataattgaaaataatatgatcaatttatgatagtgttttcatgttagatataatcaaagtatgaaatcttatatcctaagaatggttatatatggtttagtaggttaagtgtgttttgacaatgatgcataataaggatttaacttggagaaacggtgacgtggacagcttgaagcagacaccccaccagatcgatgtttaagtagtactgaacattcatatgtttgttccaccaaaatatctagttgcaaactatttttctttttgttttataaataaaattaattaattttttaatata

SEQ ID NO: 34 - DNA, 507 bp, Ambrosia trifida
atcccaccgcttttgcgctttgcgcctcggttttggacctcgtcgctttagtgcgcttcgcgctttttaaaaccaagcttctatcgagtttaatgactaaaatttagtaaaatataatgaccaatatggaaggtatttcatgacaattaaccctaaatatattaggtaaccacaaaggagggctctctgttgggaaagcaatatcctccggatgcaaagcagccgaatccgtgattgcatatttggattcttattcggaccagaagtagaaggatgggtgttgctagattatgttttaaccggtaaactttatttcttatatcttatttttattcttatttttcaatgcaaagagtcaaacgacgcaagtgtgatatcaggattggccggagaatgtagatcaaaagagtttttgttcgctcgaggttggataaatttgacgaaaattcgcttttcgttttgtgtttttgaaggtgagcaaggatggtgttgtataaacttattgtt

SEQ ID NO: 35 - DNA, 1648 bp, Chenopodium album
aaccctcaaaagaaaattttcactgcaatctttgtagccttcttgttagcaaaatactcggacaactaatcctagcaacagcgctatttgtttgagtattgtgagaggtaatccactacctcagctgcagattcataagcaccctctatacatcgccccaatgcaacacctgaaacatagttgccaccaagaaacaatcccttgaacccagcatcagttagagctgcttttgcagcatcaagcagatcaaagtggccaatcaaaaattgtggaattgcttggggccatactctcacgcccaaaacccggggatcttttgcattaggatttatgagaatgtttctcaagtccttgtcaactgccccagcaagttcatcttgcgtcttgtgtaatatactagtgtttgtagaacctccaatgtaactcaaaattaaggtcctaccaggtggtgctcgaccagggaaaagcgatgaactataaattgatcccaaggtttcaacaccctgactgcggggatgcaattgcccaaatccttgaagtttaccatcaatcaaacactctgatctaattgcttcactaggataagaaagtgacacagctgcaactggtggatagtagaactttgcaagtgattctgcagcaacatctgaaagtggacgaaggaggctacttgcaatatgtgatgggacagtcatcacaacacttttggtccgtacagaaaccagtccatctggtgtttcataagtcagattatattctccatttggcaacttaacaatactagaaagggtccatgatagtttcactttgctgccaagcctttcagaaatggctgtaggcaacatagtgagtcctttcctgaaggatccaactgtctggcccttaggtttagggaggcgcgggtctcgaggtggctttggattgttctttctttcctggattgttttgagggtaccaccaatgatactaccacccttttgttccaagatccaaactttgccaaaagcagctttcatactcaacttggaaggatcgccagcatacacgcctgaacaaaagggttcaatcaagcgttcaaatacttcatcagcccagattacgacggacaaaatcttcaacagattcctcgtgagctggaggagaaggacgtaagccaagagcaccgagtccagacctaatcttgccagggaagctcataaggtcaaagaaagggaggtcagtgggcttggacggtacaggcctcaatttgccattccacaacacaaaacgaggggcgttaggatctccaaacaccaattcatctttcaatccactgtcaacagccatggtgagcactgcatcagatggctggaagctgttaggtccctcttcccagatatagccatcggcctccacagtagtgatgtttccaccaactcgatctttagcctccgtgacaatgaaatttggggagcgggaggagtattttgtagagagagcttgtgcaatgccaagaccactgattccaccacccacaatcacacagtcaagtacttcagcgccatcgattccaacagtagcagtgtttgtgttctggtaattgactgctgaatttgaggtcgagactgtggagcaacagataatggtgttggtagcattattctgtgaa

SEQ ID NO: 36 - DNA, 1653 bp, Conyza canadensis
cgattcgagttcccggccattgctcgattgcgtggtcgtcggcgccggaattagcggactgtgtatagcgcaagcgttgtcaacgaagcacggcggcgacgtggtcgtgacagaggcgcgtgagagagttggaggaaatatatcgacagttgaaagagatggttatttatgggaagaaggtcctaatagctttcaaccctccgatcctatgcttactatggtggtggacagtggattgaaggatgatttggtgttgggtgatccaactgcacctcggtttgtgttatgggatggtgatctgaagccggtgccttccagtccatctgatttgcctacctttgatctgatgagccttggtgggaaactccgagccggttttggggctcttggaatccgccctccacctccagaccgtgaggaatctgttgaagagtttgtccggcgtaatcttggtgatgaagtttttgaacgtttgattgaaccattttgctcaggtgtttacgcgggggatccatcaaaacttagtatgaaagcagcatttggaaaggtttggaagctggagcaaaatggtggtagcattgttgggggagcatttaaagcaatccaagctaaaaataagagtaccaagcctcctcgagacccgagattaccaacaccgaagggccaaactgttggatcttttaggaagggacaagcaatgttgcctaatgccatctcaaaagggttgggtagcagagtgaagttatcctgggagctcgtaggtatcactaaatctgagaatagagggtatagtttgacatatcgaacaccagatggattggaaagtctgcagactaaaactgttgtcatgactgttccatcctatgtggctagtgacttgttgcgtcctctttcggtggaagcagcagatgctttgtcaaaattttattatcccccggttgcagctgtatctgtttcctatccaaaagaggcaattcgtgcggaccgtttgattgacggtcagctcaagggttttggtcagttgcatccacgaagtcagggcgtggagactctaggtaccatatacagttcgtctcttttccctaaccgtgctccacctggaagggttctgctcctgaactacattggaggggctacaaatcctggtattttatcaaagacggagagtcaaattgttgaagcagttgatcgcgacctacggaagatgctgataaatcctaaagcaggagagccattgaccttaggagtgaaagtgtggcctcgagcgatcccacagtttctgattggtcattatgacattttagaggctgctaaatgtgctcttagtcttgctggataccggggtatgtttcttggagggaactatgtatctggtgtagctttaggtagatgtgtggagaatgcctatgaggttgcagccgatgtaagtaattttttgtcacggggcgtgtacaagtaatacgtcactcttcggaaattagtgtttatgaggttagtaattaaagttttggcacaaggcatgtggaagtgaaaacgcggactttcagtgaagttagtcatctattctcaagcctcatggctaaatgtaattcgagttaatatactaaaaaaaaaagaaaaaaaaacaaaacatgtcggccgcctcggtctcta

SEQ ID NO: 37 - DNA, 600 bp, Conyza canadensis
ttaggtggaatgcagacacttacaaatgcactgagcaaagaagttggacaacatgaacttaatcttcaatccaaggtgcttgaaatgtcctatagctgtgatgataacactactgggaattggtcgatctattgtgctccagatcagaacaaacaattaaatcagcaaccttttgatgctgtgatcatgactgccccacttggcaatgtgaaagaaatgaagattacaaagacaggaagtctgttcctgctcaattttatacctgagcttagttatatgccagtttcagtcataatctctacattcaagaaagagaatgtgaagcggccccttgagggatttggaatgcttgttcctgccaaggagcaggaaaatggtttgaagacgttaggcactctcttttcttccatgatgtttccagatcgtgcccctgaagacttgtatctttataccacctttgttgggggaagtcgaaacaaagaactggccaatgcttcgagggatgagttgaagcagatagtaacttctgacctcagacagttgcttggagcagagggagagccacaatttttgactcactattactggagcaaagcatat

SEQ ID NO: 38 - DNA, 10631 bp, Conyza canadensis
aaaagtatatttaaaattttttgcccacaccaaaaaaaattttaaaaaaaagaagtacatatgcaatcaatgacatgcgatttcaatcccaactttcaaatctcaatttttaaatgctagtagctataagtaaataatctccattctccttctctatacatcttttcttattcaacaggtaatactttcatttattaatcataaaattatacatatatattttccctaatttttaggtttcttaatttcttttgacgtgaattgaaagatgaaaacgtgatgatagattggaagagttgaagaggggttttgttttggggaatctcatacataacacactaaacaacatattatcagttatcttgtattgatttaatataaaatatgagtactaaaataccattatatggatcgtataagtttagtgaatagttcgtgcttttggttatacgacgaaattgtagttggtttattatatcgtcttttgagtttgcattttggttgtaattggatggttattattttgtgggtatatgaatttattggaatttgatcgatatattaaaatttttgtacctatataatgttttaaatttgtcaccttacgataaagttcctggctccgccttgatagcagccttcatgtaaaattggttttcataaacgttctgagtttttataaattttgtaacatgtcattcttctggaaatatgcttctcttcaatttaacgcgtatatgagcgttgcattcgcatataatcgaatgtctcgtggaaagtactaaagacttggccaacgttaggtttcattatcatcttctaggggattgtttaagtccaacataattaagaatttacaaacagaaggaacaacgtaggaaaagtcataatcaattgaatagtttgattagtcaatttatcagtacttaaactaagatatagtaagatgaggttgaaaaacaactactataacatacaaacatatatggatcttccttaaataataacaatgttaaagattactgcaaaaattacagaccttcattttcagcaatgatggtatgaagttgaaataatcgtttgttgttttcaattaacattttttcacaaagggagagagataaatatggtgatcagctttatatttcaatataatgtgaaaggtctgaaaaaaaaatttgaccaagtgtaaaaaatatgttttggataaataaaagttaatttaaataatctactaaaattagcccctggtttacaaatatcatttcacttataatttattaaccataatttactaatttgttcagtcaaacttttttttttatatagtttctttatttaacgtactcacaacacattacaatctctcatattgggtatttttactgctgcattacgtgagtttttttttattgtatcatataatttttgacaaatgatttttaataaaacaaaccttttcactctttaatggtgaggtttcaattccacagtttaatcaattgccgatcgatgtatatatgtaatttttagttttaatttagtaaatacaaaattatttaactagggtataggaagagtagacttgaaaatatgggtgataatttcttgattctttcaatttgagtaagttaaagaaatcttaactcttcaaattttggcctttaatttatatctaaaggttaatttttatctaaaggttaacattactataacttggactaattccctccctaaaaatatatacccattttccttatctgacttggaaaatagtggggtagatcggatctgacctaacctgatttgacccgatccgacccgaacgttgaaaatgaaaattagtttactagaggtggttcacccacagagaaattataccaaaccgaaacaacccaacaatggcttctccaacaacaacaacagatgataacaaaggtagatactatttctttttcttcttaataatcttaatatgttattattttcattgtagataatccagttctgcattttgttgcacagagaaagcacctgctaagagagttgcagttgttggcgccggtgtcaggtcaatgttactactttcatatatataatatatgtatcttgcgttttattttacttcttactttttacggcgaaatacccaaatatcccaccccacggaaggttatgtagactttggttttctttgacctctatagttggttacttgttatggccatgaaatgaaagattcctaaacgagggtggagattactctagcgtttgttttgaccccaaaaatgctttgcttgtcggaggacatgaccaatatttagaggactaggattagcttagcggaatatggtagataagtaatccttttaggggtactttatataattgtggattttcatgcatgatacctttcttatatgctcatatgacttctttgcactgttaggggtagtgttcttgacagctaggtgacctatgctactttgtttcataggtcgattagggattagcacccactatttttttatttttttggaaggcattaaattatattatattaaagataaaaattgccagtaagaaactagccgatacatagactgtccaatccaaaatagaaaactagcacccacattatatgtgggcccaccggtccctaggacttcctagtaaatatctacttatatctatgtatgcatggctgataccaaccctatttgcttttgtgacttgctgggaggaggttaaaggggttcttgacttcttgcacatgccactcgtactaccaaacctatttgcttctatgacttgctgggaggagacatgcccctattaattgttgctctcatcccacatgtttggttctatgcagacggttatatttattatgtttttatgatgtttaatatgttcaaatgtcttatttactatgtattgtccaatttgggctatgtggtatgtcttctacccttgtctactcttaatgtagtaagagtatcatcatactcgatcgacaggtatggttactgaactctttacactctcctacttttgccttttttggatggaggtccttatggaagtagtctttctgcctctgggtagaggcaagactgtctacatctcacatcccccatacccctcgcacaagaattgggtcatgttgtttttgtggactcgaacccagatggtaagatgtttccaatggggtttacatattgttgattttttgctgctagtataatatattattttgattattcgttacatgtatgaaatttgtaaataaattggtgagtatagtagtctagtgcaacatggtgattgattgatatctagaggaatggctggccatattatgttgaatcatgaatgaatgacttggtttgtttcagtgggcttgcggctgcatataagttaaaactacatggaataaatgtcactgtttttgaagccggtgagatagccggagggaaactaagaagcatttcacaaaacggtttaatatgggacgagggtgccaatactatggtatgatatcgatgttagtttgcttatagacataacttctttttttttattttttttaaaaaaaagttgttttgatgctcttttactccgtatttgtagactgagagtgaaccggatgtcagcaggttgcttgatgatcttggtcttcgagataaacaacagtctgtaagttatatgctgttggatatggaacatcatgcttcctgtagcgtgcgtttgaaaatttatttttgcaaatttctcccattgtatactaaatgacatagtataaagaagaggaaattgtttatatcacttttattcgtgttcaaatacggaaggctaaatccactttatgtggctgtggctgtaataatttgtcggctatggttcttgtttcatttatttgttgtggtcatgtgtgtatatgtttaccatggctgaatactacactatatttccttttgcagccactttcccaacataagcgatatattgtaagaaatggaaaaccggtactggtatgatatctcaacaccatgctgaaaactaatcctctgttatatatgaacaaaagagtttaaaagtataagatgaaactttacttcaaaatcattagtagaaattgtgttttattggactcaaattctcaacctcataaacacttgtcatttgtttacaaagttttgtaaactgattttttgttttctgggaatgtaaataattatggcagtttattgtactgttctttcgtatagatagttataaactcaaaacacaaaaaaaaggttgttttattacgcggtcgtagctgtcacaattttagttttcttttgtacttgccaagttcatgtcttatatactgaatgtaacttggccaaactcatgtctgcaggtaccttctaaccccattgcactgatccaaagcagtttgctttccactcaatcaaaggttcgttagtagctcttggatgtttaagtctgaagtatttaaaccgtatccaatcctttcattctcatattatctacccaatgattctcaatgtcaaggctcacaaaaactctttatcctactatgctttaaatttttaataaaaatgatgcatgcccttttcggttgtatttaaaaaattatccaaaattgcaatggtaatatattagcacacgagttacacaaattctttctcattttgatatcagatgatctcaaaattataatttgtacttcattacattgtgtatgtgattatggggtttgttgcaaaaattacagcttcaaatacttttggagccattttcatggaagaagaagaactcgtctgatacacaagaaaggtaatatatagccttctttcctatctatctgttaaaccctattagggactaacttttttatttatttactattttgtagtgttggtgcattctttcaacgtcattttgggaaggaggtatatgtatattgtaacctttatcttcagttcagttattctggtatacgtctttcttttgatattaaggggtccaagttttcatttgtgtggtacttcaaaatttgtccatgctttccgctatcttaattttctatacttaatgtacatatgtaaggttgttgagtatctcattaatcctgttgttgctggaacaagcggtggagatccggagtcactttctgtgagtaactcttccatgtccatgctgcttcatattagtgtggggatatacataactgatttcaattaacaaacaaaaacactttaaagcatgtggaggtgcaaatgcattctttgacacccctgctaagtgctacctctcatcattaaccttctaggttaatctatcaacctcatattttccatacagatgcgctattcattccctgaattatgggatttagagagaaggtatgtaagctacaaaataatatgtaattcattctttaagtgagcttgattatttgttcccatgcaatctactatgattttttattataatatttataaagcttggattcttaaattcaatgtgatgacggtcaaatcaacatgcaggtttggttcactcatttctggggcatttcagtctatgatctcttctcgaggcagaaaaaagagtccttcaggaagcagcaagcgcaggcgtggctccttttcatttttaggtggaatgcaggtaagattggtgattttgtctgtcaagattcatttattggaatctaatatattctttaaagtagaaacaggccatcaatatattgcttactttgttcttttaaatctttattctcatgcagacacttacaaatgcactgagcaaagaagttggacaacatgaacttaatcttcaatccaaggtgcttgaaatgtcctatagctgtgatgataacactactgggagttggtcgatctattgtgctccagatcagaacaaacaattaaatcagcaaccttttgatgctgtgatcatgactgtgagtatagttgtgttatcttacggtgacattgacataaatttggttaatgttttgcattttgacaagactagtttgtctcagcaacttttttttgtgctatcttggtggatctggattcatcaaatattcaaatctgtggacaaaatatggaaattcttattctctatttcagaaataggagaattattgtttatacacccatttgttttaatgcttattagtttgtaagtgcaattagaacgtaattaacacagtacatgctcccgaattaggccccacttggcaatgtgaaagaaatgaagattacaaagacaggaagtccgttcctgctcaattttatacctgaggtatgttattgtaccgtgtgagttctatcatatggaattcgtgcagaaccccttagttttagctcttttgaaatttaaacaataatctttaccatggggagatatcctttaaaggaatattttctggtttttataatgcagcttagttatatgccagtttcagtcataatctctacattcaagaaagagaatgtgaagcggccccttgagggatttggaatgcttgttcctgccaaggagcaggaaaatggtttgaagacgttaggtaaagcttgcctgtgtattatcttttttttttttttccttttcatttttttttcttttttttttctttattgtctataattattattgaaaattctgttatgcaggcactctcttttcttccatgatgtttccagatcgtgcccctgaagacttgtatctttataccacctttgttgggggaagtcgaaacaaagaactggccaatgcttcgaggtaggcttgatcattgcaataatttctgctcaatattttagcttcaaatttactcaagtattgaggaagtagttgtataatggctgtctctaaaaacttcataagagaatcttcttgaccattccctataggaatatcaatctattatttatgatgattatgatgagtaagtaataatttagtttggaaacttttttggaggaaaggagaaatgttggagctttcttgttgctgtttaaggggagaggacataactcaagtataattcttgcaataatatatattttctgtaaatacagggatgagttgaagcagatagtaacttctgacctcagacagttgcttggagcagagggagagccacaatttttgacgtaaggacacattctagctctgctgcttttattaaacgttagtttatctagatcaaaggattgcaagaattgcattcctgagcactatacaaacaattacacaacttaattttcagcttagactttttcattggcgcatgttcaccaattgaaattgtttcttgaaatttaacttttttttaaaagcccgaggttcacagatacttttacaatgtacaagtagcttatgcttaatttgtcttgtgtttttttgttcatgtcatacatgataatgatgtagtttaattgcagtcactattactggagcaaagcatatccattgtacgggcgtgactatggcttagttatggaagcaattgagaagatggaaagagagctacctggttacttttatgcgggtaaacctttttgtgtttgaaataaagtagatatatacatatctatactcccttataaagagtattagatttcttaaaattaagcattttttttcttcctaaaatacccctacttatacataaaacctttatatatcatcctttcccacattgtctctaatcattacacgctctcatcgaccttttatcacccttcgccaccgccctcctccaccgcctctctcgatctccaccaccgtcttccatcaccttttagccgctacaacgcgcgggcattatgctcgttttaaaaaagcaagttaaaaaggatagtaggttgataagaatgactaaatgaggacaaatctattaggtaaccacaaaggaggacttgcagttggaaaagcaatatcctctggatgcgaagcagccgaatctgtgatttcatatttggattcatattccgatgagaagcgttgctagatgttgtggtaatactatttatgatacaaaaatgaatgaaattctgagcctgaaccatataatcctgcattttcttaattattattcaaagtgcaagacttttcaggtacgtgtacatctcaagaagttttctttccatcgggattggataaatatggcgaaaaaatagtgtggctttttccggtgtctttgaatgtagtcgaaggactaagctttagttacttttataatgcaataataatggatcaaagtgttgtagaaattgatcgttccggatgatgttaaacattgcaaaatgttgtaacaaaacatggggctcgggttttgcttaatttgcatctgtaacaaaggctcgccatttttgggtatacttttaactatctgtctcaaccaaatagtttaaataaacgtgcttgaattagttgtacttttattataaatagttaggggatgaacttttgatatagaatatacaaattttctattcaagttaattatagccgttagaaaaatccctaaataaaagccaatcaggttttaggttttttttttttcttgaaaagttttccattattttaagggttattccttgatggtgagccatttttgctcgttatagcggtctaaatagattttacctgtgaccggtgttatccattcacatggtcacctccaaaatatgcttaaggacatattcgaacttgaaatcttttgtgaggaaacatataattctttcgggttttgctaaacaaagctcaatgggtgtgcattaaatagttgtacacttaccataaaaatcaggggtgagcttttgatatgaaaaagtacaacttttttatgtactataagtgaaaccctaagggctttatttaacattttccaattctttatcactagataaacttgatgatggttagcttctttttttttcctaaacataggtgtcttactcacttagactagacccaaaagttgactcgctttgcgagcccaagtcagagtaggtaagtctctctttgggtcactagagtatttttcttaaggagtttcatccttttagagacatccccaatcaatggacctccaccctagtgttttggttggttaataatttagtattattatccctgttatatattcttacaagaggttttagattaaaacattttaggtaatattttaggagtggttagaaaagggttgatcggagaggatgtaaaatattgttacgcaaggggtcagagtggaaagataaaggccggtatagtctttcataggagtttgtgtcctcgaaattcacccaagaactttgtctttgtgctgtcgtacctttttctttttctttcccttttgtctgttactactccgtattaactgacgttttaatattgtttagcttaactaaatagattattggaggattagtatttgttgtttagtcattaattgaaggtgaatcaagatccgaataaatgaatctaaaacctatttgcttagtcataaatcttcaagaaaagatgaattgttttgcttaattttaatccttaaagcaaacatgaattgaactcttaataaaaaagagctaggtatttatgacggttattggctgctttaattaagctctttgtctgcatatcccgagtctatccaaatcatcaccccattatgctgtcggtgcttttaggacaaaatcattagtgttaagttcagtcttttaaaaccgttataaagctacaaatattagattcatcttctctacagagaggtgtatcttacattcttacacttaaaacggataaacagatgaattttttcttattttggtaattttttcgaactttttcactagtcgcttctaagattgtatataatgagattcgaacttgagacacccaattaaggatttgtgcctcgtaaatacatgagctgaagttaaagccaaatcactcttttcacttctaatacctagtagcatattcatcattcattataaaattttacacgttatagttgttcaattatttatagtcgtcattaacatctgtttgagaagttcatcaatttccagtacactggtaatcacttaaaaataattggagtcgtctgtagtcccccctcatatgtgagtactttttaaattcaagaggacccatagatctttaactacatttattgatttatacattatttcatatagcattttctgcagatacgatttgttatgtagcaacatagacccatgttcagtccaaacatactagtacaattttggagcaatgcaataatgagtatctaaagtttcatgtgagaataatcaattacttagacactagacgttttttaacaatcagtttgttcctggtacattggcaccaactcgtctgagccttcagcgcgttggccagcaagtagtttcggtttggtggtcactgtcgagcaattgggcacgttaagtattttttttacattttttatttcatatgtatctctgtgtgggtgggttgtaggtgatgtgaagaaggcgataggtcttatattagttttagaaagttttttttaaaaaaaatcctattctttaatgtaa

SEQ ID NO: 39 - DNA, 10185 bp, Conyza canadensis
atttttttatttaaaagtatatttaaaattttttgcccacaccaaaaaaaaatttaaaaaaaaagaagtacatatgcaatcaatgacatgcgatttcaatcccaactttcaaatctcaatttttaaatgctagtagctataagtaaataatctccattctccttctctatacatcttttcttattcaacaggtaatactttcatttattaatcataaaattatacatatatattttccctaatttttaggtttcttaatttcttttgacgtgaattgaaagatgaaaacgtgatgatagattggaagagccgaagaggggttttgttttggggaatctcacacataacacactaaacaacatattatcagttatcttgtattgatttaatataaaatatgagtactaaaataccattatatggatcgtataagtttagtgaatagttcgtgcttttggttatacgacgaaattgtagttgatttattatatcgtcttttgagtttgcattttggttgtaattggatggttattattttgtgggtatatgaatttattggaatttgatcgatatattaaaatttttgtacctatataatgttttaaatttgtcaccttacgataaagttcctggctctgccttgatagcagccttcatgtaaaattggttttcataaacgttctgagtttttataaattttgtaacatgtcattcttctggaaatatgcttctcttcaatttaacgcgtatatgagcgttgcattcgcatataatcgaatgtctcgtggaaagtactaaagacttggccaacgttaggtttcattatcatcttctgggggattgtttaagtccaacataattaagaattttcaaacagaaggaacaacataggaaaagtcataatcaactgaatagtttgattagtcaatttatcagtacttaaactaagatatagtaagatgaggttgaaaaacaactactataacatacaaacatatatggatcttccttaaataataacaatgttaaagattactgcaaaaattacagaccttcattttcagcaatgatggtatgaagttgaaataatcgtttgttgttttcaattaacattttttcacaaagggagagagataactatggtgatcagctttatatttcaatataatgtgaaaggtctgagaaaaaaatttgaccaagtgtaaaaaatgtgttttggataaataaaagttaatttaaataatctactaaaattagcccctggtttacaaatatcatttcacttataatttattaaccataatttactaatttgttcagtcaaactttttttttttatatagtttctttatttaacgtactcacaacacattacaatctctcatgttgggtatttttactgctgcattacgtgagtttttttttattgtatcatataatttttgacagatgatttttaataaaacaaaccttttcactctttaatggtgaggtttcaactccacagtttaatcaattgccgatcgatgtatatatgtaatttttagttttgatttagtaaatacagaattatttaactagggtataggaagagtagaagacttgaaaatatgggtgataatttcttgattctttcaatttgagtaagttaaaagaaatcttaactcttcaaattttagcatttaatttttatctaaaggttaagattaccataatttggactaatcccctccctaaaaatatatacccattttccttatttgacttggaaaatagtggggtagatcggatctgacctaacctgatttgacccgatccgacccgaacgttgaaaatgaaaattagtttactagaggtggttcacccacagagaagttataccaaaccgaaacaacccaacaatggcttctccaacaacaactacagatgataacaaaggtagatactatttctttttcttcttaataatcttaatatgttattattttcattgtagataatccagttctgcattttgttgcacagagaaagcacctgctaagagagttgcagttgttggtgccggtgtcaggtcaatgttactactttcatatatataatatatgtatcttgcgttttattttacttcttactttttacggcgaaatacccaaatatcccaccccacggaaggttatgtagactttggttttctttgacctctatagttggttacttgttatggccatgaaatgaaagattcctaaacgagggtggagattactctagcgtttgttttgaccccaaaaatgctttgcttgtcggaggacatgaccaatatttggaggactaggattagcttagcggaatatggtagataagtaatccttttaggggtactttatataattgtggattgtcatgcatgatacctttcttatatgctcatatgacttctttgcactgttaggggtagtgttctcgacagctaggtgacctatgctactttgtttcataggtcgattagggattagcacccactatttttttattttttggaaggcattaaattatattatattaaagataaaaattgccagtaagaaactagccgatacatagactgtccaatccaaaatagaaaactagcacccacattatatgtgggcccaccggtccctaggacttcctagtaaatatctacttatatctatgtatgcatggctgataccaaccctatttgcttttgtgacttgctgggaggaggttaaaggggttcttgacttcttgcacatgccactcgtactaccaaacctatttgcttctatgacttgctgggaggagacatgcccctattaattgttgctctcatcccacatgtttggttctatgcagacggttatatttattatgtttttatgatgtttaatatgttcaaatgtcttatttactatgtattgtccaatttgggctatgtggtatgtcttctacccttgtctactcttaatgtagtaagagtatcatgatactcggtcgacaggtatggttactgaactctttacactctcctacttttgccttttttggatggaggtccttatggaagtagtctttctgcctctgggtagaggcaagactgtctacatctcacatcccccatacccctcgcacaagaattgggtcatgttgtttttgtggactcgaacccagatggtaagatgtttccaatggggtttacatattgttgattttttgctgctagtataatatattattttgattattcgttacatgtatgaaatttgtaaataaattggtgagtatagtagtctagtgcaacatggtgattgattgatatctagaggaatggccggccatattatgttgaatcatgaatgaatgacttggtttgtttcagtgggcttgcggctgcatataagttaaaactacatggaataaatgtcactgtttttgaagccggtgagatagccggagggaaactaagaagcatttcacaaaacggtttaatatgggacgagggtgccaatactatggtatgatatcgatgttagtttgcttatagatatagacataacttacttctttttttttattttttttaaaaaaaagttgttttgatgctcttttactccgtatttgtagactgagagtgaaccggatgtcagcaggttgcttgatgatcttggtcttcgagataaacaacagtctgtaagttatatgctgttggatatggaacatcatgcttcctgtagcgtgcgtttgaaaatttatttttgcaaatttctcccattgtatactaaatgacatagtataaagaagaggaaattgtttatatcacttttattcgtgttcaaatacggaaggctaaatccactttatgtggctgtggctgtaataatttgtcggctatggttcttgtttcatttatttgttgtggtcatgtgtgtatatgtttaccatggctgaatactacactatatttccttttgcagccactttcccaacataagcgatatattgtaagaaatggaaaaccggtactggtatgatatctcaacaccatgctgaaaactaatcctctgttatatatgaacaaaagagtttaaaagtataagatgaaactttacttcaaaatcattagtagaaattgtgttttattggactcaaattctcaacctcataaacacttgtcatttgtttacaaagttttgtaaactgattttggttttctgggaatgtaaataattatggcagtttattgtactgttctttcgtatagatagttataaactcaaaacacaaaaaaaaaggttgttttattacgcggtcgtagctgtcacaattttagttttcttttgtacttgccaagttcatgtcttatatactgaatgtaacttggccaaactcatgtctgcaggtaccttctaaccccattgcactgatccaaagcagtttgctttccactcaatcaaaggttcgttagtagctcttggatgtttaagtctgaagtatttaaaccgtatccaatcctttcattctcatattatctacccaatgattctcaatgtcaaggctcacaaaaactctttatcctactatgctttaaatttttaataaaaatgatgcatgcccttttcggttgtatttaaaaaattatccaaaattgcaatggtaatatattagcacacgagttacacaaattctttctcattttgatatcagatgatctcaaaattataatttgtacttcattacattgtgtatgtgattatggggtttgttgcaaaaattacagcttcaaatacttttggagccattttcatggaagaagaagaactcgtctgatacacaagaaaggtaatatatagccttctttcctatctatctgttaaaccctattagggactaactttttatttatttactattttgtagtgttggtgcattctttcaacgtcattttgggaaggaggtatatgtatattgtaacctttatcttcagttcagttattctggtatacgtctttcttttgatattaaggggtccaagttttcatttgtgtggtacttcaaaatttgtccatgctttccgctatcttaattttctatacttaatgtacatatgtaaggttgttgagtatctcattaatcctgttgttgctggaacaagcggtggagatccggagtcactttctgtgagtaactcttccatgtccatgctgcttcatattagtgtggggatatacataactgatttcaattaacaaacaaaaacactttaaagcatgtggaggtgcaaatgcattctttgacacccctgctaagtgctacctctcatcattaaccttctaggttaatctatcaacctcatattttccatacagatgcgctattcattccctgaattatgggatttagagagaaggtatgtaagctacaaaataatatgtaattcattctttaagtgagcttgattatttgttcccatgcaatctactatgattttttattataatatttataaagcttggattcttaaattcaatgtgatgatggtcaaatcaacatgcaggtttggttcactcatttctggggcatttcagtctatgatctcttctcgaggcagaaaaaagagtccttcaggaagcagcaagcgcaggcgtggctccttttcatttttaggtggaatgcaggtaagattggtgattttgtctgtcaagattcatttattggaatctaatatattctttaaagtagaaacaggccatcaatatattgcttactttgttcttttaaatctttattctcatgcagacacttacaaatgcactgagcaaagaagttggacaacatgaacttaatcttcaatccaaggtgcttgaaatgtcctatagctgtgatgataacactactgggaattggtcgatctattgtgctccagatcagaacaaacaattaaatcagcaaccttttgatgctgtgatcatgactgtgagtatagttgtgttatcttacggtgacattgacataaatttggttaatgttttgcattttgacaagactagtttgtctcagcaacttttttttgtgctatcttggtggatctggattcatcaaatattcaaatctgtggacaaaatatggaaattcttattctctatttcagaaataggagaattattgtttatacacccatttgttttaatgcttattagtttgtaagtgcaattagaacgtaattaacacagtacatgctcccgaattaggccccacttggcaatgtgaaagaaatgaagattacaaagacaggaagtctgttcctgctcaattttatacctgaggtatgttattgtaccgtgtgagttctatcatatggaattcgtgcagaaccccttagttttagctcttttgaaatttaaacaataatctttaccatggggagatatcctttaaaggaatattttctggtttttataatgcagcttagttatatgccagtttcagtcataatctctacattcaagaaagagaatgtgaagcggccccttgagggatttggaatgcttgttcctgccaaggagcaggaaaatggtttgaagacgttaggtaaagcttgcctgtgtattatcttttttttttttttccttttcatttttttttcatttttttttctttattgtctataattattattgaaaattctgttatgcaggcactctcttttcttccatgatgtttccagatcgtgcccctgaagacttgtatctttataccacctttgttgggggaagtcgaaacaaagaactggccaatgcttcgaggtaggcttgatcattgcaataatttctgctcaatattttagcttcaaatttactcaagtattgaggaagtagttgtataatggctgtctctaaaaacttcataagagaatcttcttgaccattccctataggaatatcaatctattatttatgatgattatgatgagtaagtaataatttagtttggaaacttttttggaggaaaggagaaatgttggagctttcttgttgctgtttaaggggagaggacataactcaagtataattcttgcaataatatatattttctgtaaatacagggatgagttgaagcagatagtaacttctgacctcagacagttgcttggagcagagggagagccacaatttttgacgtaaggacacattctagctctgctgcttttattaaacgttagtttatctagatcaaaggattgcaagaattgcattcctgagcactatacaaacaattacacaacttaattttcagcttagactttttcattggcgcatgttcaccaattgaaattgtttcttgaaatttaacttttttttaaaagcccgaggttcacagatacttgtacaatgtacaagtagcttatgcttaatttgtcttgtgtttttttgttcatgtcatacatgataatgatgtagtttaattgcagtcactattactggagcaaagcatatccattgtacgggcgtgactatggcttagttatggaagcaattgagaagatggaaagagagctacctggttacttttatgcgggtaaacctttttgtgtttgaaataaagtagatatatacatatctatactcccttataaagagtattagatttcttaaaattaagcattttttttcttcctaaaatacccctacttatacataaaacctttatatatcatcctttcccacattgtctctaatcattacacgctctcctcgaccttctatcaccctccgccgccgccctccttctccaccaccgccctcgatctccaccaccgcctcccttttatattgtcatcgccttttagccgttgcaacgcgcggacactatgctcgtattaaaagtagtaacgtaataaacataaagtttacgtaaagtttatatatttcattattttgttatgattttgtactgatgaatatatatttaagctaaaatcattcactctagagtgtaagtcgaacgggtccaaactgaactaaactatttgtctatggtagtcaaattcttaatctttttggtatcgatcgttgtgtagtgttgcacacctcacttgatattagttttatgtgattatatatggttaatttaatttttctttgatttttgatcatggtcttaaatatcattaaaggtgaagaaacatgtgaagagggataaatttggagaaagaatggcatcactaaaacagatagtgtcaccctatggcaaggttagtccttctttaagtttattaattatatgtaatttgtttgattaggtatatcatatatgtatactagttgttttgatttccaatctatacaagtaggattttgctaaacatagttgtaagggttatagttacaacacaatagaatggtatacatacattatatatatataaagatatataactgtttattaataataatctttaaccgtcatgtaaaccaatttactttgctttatccatatccttaaaggctatgaatagcatagtcgatgtaagtatatggttgcttagacggtgtgttaatgttgatcgtacaggagtctagacttggaccattgtgttttagagaagaagggaatcgaacgcaaaggtaaaacttcctttatttttaagagcatagttataatatcattcaaatttaaccaacaatttctgttacatacatcgaaataggcttgattactcatacctatagagatgagtgacatgtgtgtatgaagatttatatattgaattgtaggatatcattttcccatttctaatgtactagttaattatggtttgcggtttttttctttgttgtatgtccattacaaaattacagttggacatcttcttggtggaattcagatgatataaaatagttaattttaccaaacactacatcattggtagagagaaattagaacgtagataaatggtttgtaagtttcaaaagagatactcgtattacataaaatgttgtcttttgcaattcgcagatttccaattacaacagatttgacacaatgttctattatttgttaatccaaccatgaaccactaataaaacagtacaaacatcttgaataaaaaaaagccaccaatacattattgattgttgtatgctttttgtctccatataatgaccagtaatatcaaaaaacatgtattttattcttattctagcttaaaaaggttcaaaaatgcacatccaactttctctcttctttccaatcatagcttttcaaattaaaagcatacacgtaaaagaaacatatggatgtagattgatatgtgtgtggggggtagttggttaaccatgtcacgtgctctgcatcacctcccatccttggaccccaatttgttttttgtacctactacatatttaagtaactttatggcacctcaccaaaaaccaaccaaacaaaccaaactcccaactatacatcacttaattgcacacacacatatacctcaacaagtacttacatctctcccagatttctgtcattccaattttcttgtttttaatcacaattttgttgttgttgtcaatgtctgtctcttttcaaaccagctaaaaaaagaagcaaattcttgatttgattcagctgttgttccacttgtttatggttagtctttctcattctttcaccccccaagtttaaatctttgagttaatttcttcaaattcctgtgttttttgaaccgggtttttatcagttttgttgagtttagcaaaaaagtagagttgggtatgtaaagattgaatctttttactgggtttatgtaatttctttgaaatttataagtttcttgcaatgggtatatgattttctattgattgaagtggttaataacaggatttggtgagtaaagtttgaatctttcgagttatggatttatgtcataccttttcttgcccttcaaaataaagtcaaagctttagttttgtgatttgactttggtatcccttcaaaataaagtcaaagctttagttttgtgatttgactttggtatgctgttgctcccatgaatattttcatgctgtttgtaaattgtaatatatattttgataaattcaattttgttatatttgtttcctgataaagttttaatgtgattagtgattacttcaatttgatgagttc

SEQ ID NO: 40 - DNA, 2634 bp, Conyza canadensis
cgtcaccatactgccacggtcgccacaccttcgtctctatcactatcaccgtcgcatcgcacggacatcatctagtcaatatttatttatgaggaatggagatatatctatactttcatattaaattaaactgcctatttttttcaactattctacctttgaaatgcctattataccctcctataaacaactatccattctactcttttaattgattttctcgtactacccttccatctatttcccaatacttatccctaatctctaatcccctcctctcttgctgtcgccgaaaacctaatagaaaaattagtttcatttctacggcaactaccataaacctacaaaaagattggttttatctctccctcaccaccaccaccacaaatcacccattccttacaagctctcaaatcggttaggtgattttccattgaaatcgcttgtttttattttattttattatatctaatttcctaatttaaatccattgtttttgtatttttcccaattttctttttgaatttggtttgggttaatgttctgatcatccatgtattttgttcgtacattcacaaaagaaaaaggtaccgacacatttaatgatcacttttttaaaggtaccgtcgcatcatgtgggtacccatctagctagttgatgaataaattattagtattgttaaatttaagttttttgtttaatgagtaatttaagagtatgtttaaatttgggttaaaaaaaaaagaaaaaaaaagtaaatgtgtattgatttgtaagttgtaaccgtctaatattataaaaagaaaaagagaaaccactcctatataaaacagtcaagcctcttgtatcattaaccgggttgatttaagagcgaactttgatcgaattttgggttttcgaatttgctttccatccacatcgatatctgcccaagtaagaaaccctcgttcctgtctctctttaatttacatctccatgtgcttttcgatcctaattataaatatgcggataaccgcagcattactacccgacgcccaaaggaagaggaaaaagtcgtcgtcaaaggcagatcaacaaatattgatatattgataataatgtaatagaatatgagaggcttccagccaagtccgcatgtcgtttcaagtctgtttccaaacactggaattcgttcctatccacacgtatgtttggaccaccagctccatcacatgaacaaatcctataaacttctcttacttgaccagctagccccctgtagataaggatttatgcagcaaacccctcaaccacgtacggttccattaccgtcggttttaatcgactggaggaagccgatcctagatttaattcgcttgtaggatggattggtatgtgtagccgatccttgatctatatttcaatttcactggctaggtgtaggcattattattaagcaatgtgatcgattgatggctaattcaggcgtttgaattcaacttttcattagtcaagtaattattctcaagtttatatattaatagtatatatacgatatcatagtataatatacaaaataaaatctatccaaaaggaataaaatctttggaaaggaataaaatctatccaaaaagaataaaatctatccaaaaggaataaaatctttctaaagatttcggacattcactataaatagtgacagcagatgagatggaaagaaaaaaagaaaaaaaggaacaagaatactcctttggagagaatacttgaactctcatccctcaaatcattgttaacataatcactaccctcataggattggatggcgtaaaaccgtatacgtaatacggttaccagcagggatcgccacccaaatatcctaatcttcctcacaccttcccatgctaggtggcatgggacccacataactctctttatttatataatgatattagattacatactccttgaaccgtaagtgttaatcgacgtatcatcatatatacactaatatctatgttaaataattaataaacaaaatatgacacataaaatttttgcgagatatttttggcgaagcattgcacaaaaagcagcaaggctaggatatttttggcccacaatgtaccgcgatgcaacaaagattgtcgacaattgtgataattgccaatgccatgctcctatcatacgtcaaccccaacacgacttgacaagtatttcaagtccatggccgttctatcaatggggaacagatatcgtaggaccattcccagaagcaccaggaaaagtgaaatttttggtagtcgcaatcgactattttactaaattggcagaagcagagccactggcaacaataactggacataaaatactcaagttcgtatggcgcaacattgtatgtcgttatggaattccaggaattatcatcagtgacaacggaaagcaattcgcaaataacccatttcgggagtggtgtgaagagcttaaaataagacaacaattcacttcagtcgcacacaggtcaaacagaggtaactaaccgcaccatcctacaaggcctcaaaacaaggctaaacaaggcaaaaggacaatgggtagaggagttaccaaacgtcttatgggcatacagaataacagcgaaaacggctacgggttgc

SEQ ID NO: 41 - DNA, 1631 bp, Euphorbia heterophylla
attgcgtgattgtaggaggtggaatcactggtctctgcattgctcaggcacttgccactaagcaccggaatgttgctcccaacgttattgtcaccgaggctagagatcgcgtcggtggcaacatcaacaccgttgaaagggacggctatctctgggaagaggggcctaacagtttccagccctccgatcctatgctaaccatggcggtggatagtggtttgaaggatgacctagttttgggggatcctacagcgccacggtttgtattgtgggatgggcaattgaggccagttccttctaagccaagtgacttgccgttctttgatttgatgagcattggtggaaaactcagagctggttttggtgctcttggacttcggcctccacctccaggacgtgaggaatcagttgaagagtttgtgcgccgcaaccttggagatgaagttttcgagcgtttgattgagccattttgttcaggtgtttatgcaggtgatcctgcaaaactcagcatgaaagcagcattcggaaaagtttggatgctggaacaaaatggaggcagtatcattggtggcacttttaaagcaatccaggaaaggaataaaaatcccaagcctcctcgagacccgcgtctaccaaaaccaaagggccaaacagtagggtcttttaggaagggactgactatgcttccagaggcaattgcatcaagtttgggtagtaatatcaagttatcttggaagcttctgggtatctctaaattggacaatcgggagtacagtttaacatatgaaacacctgaaggatcagttactgtgcagagcaagagtgtcgtacttacaattccatcccatattgccagcaatatcctgaatcctctttctacaactgctgctgaggcactgtcaaaattttattacccaccagtagctgctgtgtctatttcatacccgaaagatgcaattcggacagaacgtttaatagatggcgagcttaagggatttggtcagttgcatcctcgtagtcaaggagtggaaactttaggaaccatatacagctcatcacttttccctaaccgagcaccagatggaagaattttgctcttgaattacattgggggtgctaccaatcctggaatattggccaagaaagacagcgaacttgttgaagcagttgaccgtgatctgcgaaagatgctcataaatcccaatgcaaaggatccacttacacttggcgtaagagtgtggcctcaagccattccacagtttctgattggtcactacgatatcctagatacggcgaaaaatgcgttaagtgaacaaggcttggaagggctgtttttagggggtaactatgtgtatggtgtagctttgggaaaatgtgttgaaggagcatatgaaactgcgtccagtgttactaatttcctaacccagtatacttataaatagtatctgatgagatttaagcaagagttcaattatgctgcggctaagtactgtgagtttattgagtagtgggtaaaaatgttgctttaggtctgttgtatttgtaatagttgcttcacgtttttcattaaggatggtgtattctctagttatgcattcttgttcatttatcaggcaaaacgagtttgatgt

SEQ ID NO: 42 - DNA, 480 bp, Euphorbia heterophylla
acaggttgtgcattccacccagaaacgtcagcgtggttcattttcgtttctgggtggaatgcagactcttcctgacaggttgtgcaaagagcttgcaaaagacgagcttagacttgagtcaaaggttttgtctttgtcttataatcacgattctagatcggcgttagacaattggtctgtctcttttgcttctaagggcaacaaacgtatgcaagactcgtcatatgatgccgtcattatgacggcaccactttgcaacctcaaagaaatgaggatcacaaaaggcagaaatcacttcctgttggactttattcccgaggtaatttatatgccactgtcggtcattattacgacgttcaagaaggagaatgtcaagcaacccctcgaaggttttggagttcttgtaccttctaaggagcaacaaaatggtctaaaaacgcttggcacactgttttcgtctatgatgtttcctgaccgtgc

SEQ ID NO: 43 - DNA, 4067 bp, Euphorbia heterophylla
tttattgtgtaataattaaaggataatattactgtaaaataatttatattatttaatataataattttaatattattatttttccttaaaagaattataaatgagcttgtaatgttcatgaacaatccatgaataagccaattgttaaatagaccattcatgaatatgcattttgagctcgaattaaactcagcttatttacattgttgtacatgtgaaatcaagagaatgctcataaagtgagtattaaaccgaaacattttatatttcttaaaggtctgacacatgaattctgagaaatcaaatctgtaatattttgacaaatgaaataaatcgtaaaatacatatattcattttagtaaaatctctaaatttttaattctttcaatcttaacatcttcttcctcaaatccttgtaacaaatcacagcacaatattttagcattcaaattcatagaatataattaaccgttcaaatctaccaatcccacctccttacccacagcttctactccgagtccattcattaaccctcctctctttgttacaaattcttccatgtcttatttttactaaaatctatgctatctatgtttcctaaaattattccacctgctttcagttttaataaaacttcagatactttgaagaactccaacactccattaaatgagaccaagtttcgcaagtcgggctaccctttgttgggcccaagcgcaatttggacacctattttttactaagttcggcttaagcctcagcccgtcaaaatttaaagttttatgcgttgagctgggttttttacaattatccgagcctaatccgataaataataatttaattttttttatatattatatattgtactaaataattatttcaatatttatatttcaaagttatgggtgtgcatctggttaaaacctaatagaatcgaataaatcgaatatcaaatagagaaaccaaaccaaatacgaatcaaaatcgaattaaccaaatcaaaaataaattattccgtttggttaaaaaccgaaccaaaccaaatttttttaaaaaacaaacttaaattaaaaattttaactcttaaaatccaaaaataagtattacaatagttcaaatgacttagttttgacacataaatgaatgagggtgcattttggggtttgatgttaaaatgatctatatttgagcattattagtagaatattttaaatttttattatgatatttcaattcgattcggttattgtagttttttcaacactaaaactgaactgaaaattgaaatgtttaactttaataaataaaccgaaccgaattttcaaagtaaccgaaccaaattaataactcagtcttattcgattcggaaatgtagttaccaaaaccatttgcacacccatattttacactaatgaatttttaaacttaaatacaataaattgtataaattattaaaaatttcaaataaataatataatcatacgtaattttgtcaatttatttcttaaaatctataaaaaaaaaagttattaaaatactatctacagcctttggaaatgattccataagcctgatccgagcacggagttctaaaatacggattgaagcagacttggaatgatacttttgtcgaaagcccacaaagtctggcctgttcgattaacatgtcaaaacaatagaagaaaatatctttttattttcgtgtaaatgaatttaccagtaaggttgcgtttatcatttgtagccttcgtccaatcagattgacacgctatatttctccttgtcaattgaagataacacagcactatttccctattagttctgaggccgccactaaacggagtgcgcttgcctcttaccaccacctttcgccgccatggcctctatttccgacttgtctcttttccggccaacaccttctcttgttccatcattttccaaacgcaatttaaacaactctatccacaaacaattcaaactccgatgctcaattacagagcagccttccacaatttccccatccaatcccggagacaaatccttatccggcaacggacattccgcctcagtagattgcgtgattgtaggaggtggaatcactggtctctgcattgctcaggcacttgccactaagcaccggaatgttgctcccaacgttattgtcaccgaggctagagatcgcgtcggtggcaacatcaacaccgttgaaagggacggctatctctgggaagaggggcctaacagtttccagccctccgatcctatgctaaccatggcggtgaggatccaatttctaattgattgtcatgtctaacaaattattgacgaaatttgcttgtaattggagattttggttgaattagctaatttgatcgtattgtaggtggatagtggtttgaaggatgacctagttttgggggatcctactgcgccacggtttgtattgtgggatgggcaattgaggccagttccttctaagccaagtgacttgccgttctttgatttgatgagcattggtggaaaactcagagctggttttggtgctcttggacttcggcctccacctccagtttgtcctctttaactttcttattgtaattgttctccgattgaaaatagtcccccgtgtgtaattttatctgctcgtaaccttacaattctgctgaaagtgacagggacgtgaggaatcagttgaagagtttgtgcgccgcaaccttggagatgaagttttcgagcgtttgattgagccattttgttcaggtaagttaagatatttggagcttgtagtgttcttattagttgacactgtatcatgtcaagttgtgttatcagacccattacaacatcttaccaatcatcacatgaatattgctgtatttcccatgtaaaattaaaccgatacaacatacctcgacttaaattgacgaatacaattcaatgtagtggtacttagttgacgtcccttttggttcgacgacctcttttaattatgatatgttgtgttatatctaaacactaaattatgaatttcattcaaaatctatgccattgttaatacaaatcattatcaaacttgaagtgaattccattattgaagtttatattgcatgctcaatctcatccatctgatatttgattcatttatttaagtagtcctttagcgtgcatatcgtgaatggttccttgagatgtgcttttgatcatgtagcatccatcatggtgatggcttatttgttctagctatatataagatgataagagaatgactaaatgggtaacttgtctatgctgtccagaggtgtttaattgctttgcagtatctgaaaaagagtcagttggtttccctatgatgtatgcttctcaaacttaaaatcgccctagttgattttgttgctaaattcggaagttttatttgtataatttgtatatcttgacaaggttgtccttaatgggagatgctatttttcatgtgcaggtgtttatgcaggtgatcctgcaaaactcagcatgaaagcagcattcggaaaagtttggatgctggaacaaaatggaggcagtatcattggtggcacttttaaagcaatccaggaaaggaataaaaatcccaagcctcctcgagacccgtatatttatctccttgctttgagaatatcttacatcttttgtttttgttgagtttcttgactctagtgccctgcaggcgtctaccaaaaccaaagggccaaacagtagggtcttttaggaagggactgactatgcttccagaggcaattgcatcaaggtaacatttccaccggaattaaaattttatgaactttagatggttgtaataattcttgacagtggctgaagtaattgactgattacctgcattggtgttgcagtttgggtagtaatatcaagttatcttggaagcttctgggtatctctaaattggacaatcgggagtacagtttaacatatgaaacacctgaaggatcagttactgtgcagagcaagagtgtcgtacttacaattccatcccatattgccagcaatatcctgaatcctctttctgtatgtttttc

SEQ ID NO: 44 - DNA, 2630 bp, Euphorbia heterophylla
tacactaataaatttttaaatttaaatacaataaattgtataatcatatataaatttatcaatttatttctttaaaatctataaaaaaaagttaataaaatactatctacagcccttggaaatgattccataaacctaatccgagtacggagttctaaaatacggattgaaccagacttggaataatacttttgtcgaaagcccagaaagtctgggtccgctcgattaacatgtcaaaacaatagaagaaaatatctttttattttcgtgtaaatgaatttaccagtaaggttgcgtttatcatttgtagccttcgtccaatcagattgacacgctatatttctccttgtcaattgaagataacacagcactatttccctattagttctgaggccgccactaaacggcggtgcgcttgcctcttaccaccacctttcgccgccatggcctctatttccgacttgtctcttttccggccaacaccttctcttgttccatcattttccaaacgcaatttaaacaactctatccacaaacaattcaaactccgatgctcaattacagagcagccttccacaatttccccatccaatcccggagacaaatccttatccggcaacggacattccgcctcagtagattgcgtgattgtaggaggtggaatcactggtctctgcattgctcaggcactcgccactaagcaccggaatgttgctcccaatgttattgtcaccgaggctagagatcgcgtcggtggcaacatcaacaccgttgaaagggacggctatctctgggaagaggggcctaacagtttccagccctccgatcctatgctaaccatggcggtgaggatccaatttctaattgattgtcatgtctaacaaattattgacgaaatttgcttgtaattggagattttggttgaattagctaatttgatcgtattgtaggtggatagtggtttgaaggatgacctagttttgggggatcctactgcgccacggtttgtattgtgggatggacaattgaggccagttccttctaagccaagtgacttgccgttctttgatttgatgagcattggtggaaaactcagagctggttttggtgctcttggacttcggcctccacctccagtttgtcctctttaactttcttattgtaattgttctccgattgaaaatagttccccgtgtgtaattttatctgctcgaaaccttacaattctgctgaaagtgacagggacgtgaggaatcagttgaagagtttgtgcgccgcaaccttggagatgaagttttcgagcgtttgattgagccattttgttcaggtaagttaagatatttgtagcttgtagtgttcttattagttgacactgtatcatgtcaagttgtgttatcagacccaatacaacatcttactaatcatcacatgaatattgctgtatttcccatgtaaaattaaaccgatacaacatacctcgacttaaattgatgaatacaattcaatgtagtggtacttagttgacgtccctcttggttcgacgacctcttttaattatgatatgttgtgtttatctaaacactaatttatgaatttcattcaaaatctatgccattgttaatacaaatcattatcaaacttgaaatgaattccattattgaagtttatattgcatgctcaatctgatatttgattcatttatttaagtagtcctttagcgtgcatatcgtgaatggttccttgagatgtgcttttgatcatgtagcatccatcatggtgatggcttatttgttctagctatatataagatgataagagaatgactaaatgggtaacttgtctatgctgtccagaggtgtttaattgctttgcagtatctgaaaaagagtcagttggtttccctatgatgtatgcttctcaaacttaaaatcgccctagttgattttgttgctaaagtcggaagttttatttgtataatttgtatatcttgacaaggttgtccttaatgggagatgctatttttcatgtgcaggtgtttatgcaggtgatcctgcaaaactcagcatgaaagcagcattcggaaaagtttggatgctggaacaaaatggaggcagtatcattggtggcacttttaaagcaatccaggaaaggaataaaaatcccaagcctcctcgagacccgtatatttatctccttgctttgagaatatcttacatcttttgtttttgtttagtttcttgactctagtgccctgcaggcgtctaccaaaaccaaagggccaaacagtagggtcttttaggaagggactgactatgcttccagaggcaattgcatcaaggtaacatttccaccggaattgaattttatgaactttagatggttgtaataattcttgacagtggctgaagtaattgactgattacctgcattggtgttgcagtttgggtagtaatatcaagttatcttggaagcttctgggtatctctaaattggacaatcgggagtacagtttaacatatgaaacacctgaaggatcagttactgtgcagagcaagagtgtcgtacttacaattccatcccatattgccagcaatatcctgaatcctctttctgtatgtttttcataatca

SEQ ID NO: 45 - DNA, 1010 bp, Euphorbia heterophylla
agattagtgaatgatcacaacaaataccgtttgataagtccaattttttctttttttgcaagatttggttctattatagctggggcaattcagtcaaatttttcctcgaaaaaggataagagcaaggagacaaattcatcaagacataagaaacgtcagcgtggttcattttcgtttctgggtggaatgcaggtattagatgtaggatattacttatgaactctgaaatttgtatctaatatcacttttcttaaagcccctaaatgattttaatattaggattttctttttgtatctagctttattatttgctcgattttactcgttaaagctatgtttatttgttgagaagccttctagaggcgatacagattttcttagcttatgcaagtgattatcctatgaactatttatgttttcttttcccgaatctatttttctttgcagactcttcctgacaggttgtgcaaagagcttgctaaagacgagcttagacttgggtcaaaggttttgtctttgtcttataatcacgattctagatcggcgttagacaattggtctgtctcttttgcttctaagggcgacaaacgtatgcaaaactcgtcatatgatgctgtcattatgacggttagcaacttctttactgatgatataatgtttatcaattaatctttttgatatcgaaacgaaacaatttcattgtttactcagattcattatcacttctaaaatttcaggcaccactttgcaacctcaaagaaatgaggatcacaaaaggcagaaatcacttcccgttggactttattcccgaggtacccttcttgcaaatctattgacaagaatggatgtcaataattcaaccgaaaccatatgaactattgcaggtaatttatatgccactgtcggtcattattacggcgttcaaaaaggagaatgtcaggcaaccccttgaaggttttggagttctggtaccttctaaggagcaagaaaatggtctaaaaacgcttggt

SEQ ID NO: 46 - DNA, 855 bp, Euphorbia heterophylla
acttttttacatgttcagggggttatttgaaacatttgaaagttcaaggggtaactagccctttttgaacaagttcaggggttttcatgtattaggcctctatttaatattggatgctccaattggacacctgagctttatgttgtcataattagtagtagatatagctttcttttaattttcacgtgtttttttcgtgtaaatagaaagacagcgaacttgttgaagcagttgaccgtgatctgcgaaagatgctcataaatcccaatgcaaaggatccacttacacttggcgtaagagtgtggcctcaagccattccacagtttctgattggtcactacgatatcctagatacggcgaaaaatgcgttaagtgaacaaggcttggaagggctgtttttagggggtaactatgtgtatggtgtagctttgggaaaatgtgttgaaggagcatatgaaactgcgtccagtgttactaatttcctaacccagtatacttataaatagtatctgatgagatttaagcaagagttcaattatgctgcggctaagtactgtgagtttattgagtagtgggtaaaaatgttgctttaggtctgttgtatttgtaatagttgcttcacgtttttcattaaggatggtgtattctctagttatgcattcttgttcatttagcaggcaaaacgagtttgatgtgcattcagaatatgttggcagttgattgacactctaagcttacaggaagtatggaactgtatagcccatgagaatctaaaatctctaacactagccgttagtacaatggccggactatgcccaagtagttaactgttatagccagtgttttaaaaatcgg

SEQ ID NO: 47 - DNA, 121 bp, Euphorbia heterophylla
aaccgaaccgaattttcagagtaaccaaaccaaattaataactcagtctgattcgattcggaaatgcggttaccaaaaccatttgcacacccatattttacactaataaatttttaaattt

SEQ ID NO: 48 - DNA, 77 bp, Euphorbia heterophylla
ttttttcaacactaaaactgaattgaaaattgaaatgtttaactttaataaacaaaccgaaccgaattttcagagta

SEQ ID NO: 49 - DNA, 444 bp, Commelina diffusa
gctatatgaaacatcagaaggattgacttcagtacagactagaagtgttgttctgactgttccatcttatattgccagcaatctccttcgctctctttcaaatgacgcagctgatgctttgtcaaagttttactatcctccagttgctgctgtttccatttcatatccaaaggaagctattaggaacgaatgtttaatcgatggtgagcttaagggatttggccagttgcatccacgtagtcaaggagtagagacactcggaacaatatatagctcatcccttttcctggccgagctccccaagggagaatattgcttcttaactacattggaggtgctacaaatactggaattgtatcaaagaatgagagcgaactggtagaagcagttgatcgtgaccttagaaagatgctgataaagccaactgctgaggatcctcttctt

SEQ ID NO: 50 - DNA, 3043 bp, Commelina diffusa
aattttcttgtgttatgggggaaaaaatctatattgtcataaagagaaaaaaaaattgaatatacaaaccacaacaattagattgctttttccctactatatggggttagctatatgaatcttagtttgcattttttcttatctaaaaaccatttctttagatggccctagataagacagtcaccttttaggacttcgtgaagtgacttttttttttggttatataccatggttgcaagtctcagccaataccaatacgtatcatgtatcgagatcggtagctactgttataggatcgacatagtatcttggattgacatttgcttgttggctggctggccaattttggccagagaatggtaggagttggccggtacgaccgtaacggtgtcaatttcacttggtatcagccaatatcgatcattatgagctctgacaccgttgatattgtattgaaaattaaaatttctattttagaaagttaaatttttattagtttatttatttcttgttaactaatattatcaatattgatacgtatcagatttgaggaaacagatttgcagtcctggtctaaacctctaccctgtgtacgactaccgaaatctagtattgtaacttttctaacaggtgcatctactatctatagaacgtctacaaacacgtacaaactgctgtaaaggattttttcctaaacttgttattaatatgagtcacctatagttttccttgcacatacttgtttggagttgatctttcctagtgacacctaacttccacctcaacgttcttatctgtgctagacgcactgtttgggtatcttgcttcttaagagcccattattttcataaatcattgtagacctaataccaattttatacaatttacccttagatttaagagactctacaatcacataacattcatgaagtttcttgccattttaaccatcttgttttaatgctattaataatatcttctatattttctctattatcttgaataatggacacaagatacataagttttttatttctaaccaactatactccatctaacataacaaattaatttgttcttgtcctactattaatatttcgtttcatatattttgttttaactctacttcatttaaaactaaaattacatgctggaactgaggttctaatcttaagttaacaccttctgctctctcatcatataaaacttctcaacaaaaaatttatgccaaggaatatcattctagatatgccaaagtcaatagaagatatgaatttaaagaaccttggtggactcctattgtgataggagatctattgaactttcttacttatttttaattatgtcttatatctactagaaaccatttgcttttctaagatctaccaaagaacatccataggtattctatcatatgcattttctgagtcaataagaaccatatacatgtctttgttcctatttctaagcgtttgtactaattgccttgataaactgatagtggtaggtataaatccaaaatgattattagaaatattagtttcacatcttagtcgttgttctgtcactattcttttcctactttcatcttcctaagagcatcttttacttcacaagtcctgatgttttgaatataagtagttctttttttttttaattagtggaatttacctgtaaaactatgtctagcaaggctctctccaagtgtaactttataatcctcataaatcctctgatcaccatttctagtgagaaaaggaaatcaatttggcccctactagaactatccttaaaagtaattaaatgacagtctctctttccatatagaataatgattaccaccgtattgtacgataaagcagattctaaaattttgacctttacattattcatctccccatacccataatcaccacaagtaaacttaattttcctactatcttttgcctacgtgtcatggatgagtaccaggggaggaggagaggacaggggaaaaaggaacaaaatggaatcaaaataaaataaaatgctcatgccaacaataatgtggctaaaatcggacggaaaactaccgatggaagtttttgcagcatttaatgaaatgttaagtgtatttgctatttcaaaaaaactcaattattttttattgttttggcaaaggtttagattttatctgcatttaactcttataaaacattatgaaatgatatttgttatcgactttcttgcactttcatgtgctaagcgtgtcacaactgctgaatgctactatgcaggaacaatatatagctcatccctttttcctggccgagctccccaagggagaatattgcttcttaactacattggaggtgctacaaatactggaattgtatcaaaggtgttggaacttgaccatttttcagtttttgtgaagttgcaaaaagttatatcctctacgaaaacatatgcagcttaggctatccataatatataatccatttttaattagtgaaaacatatttcctaggaaacctcaattaaaatgtcatccattatgtctacaattgatactttattttgtttgctcttcttttccagacagtttttctagcatttacaccatgttgccactaggaatattgagtttggactggtttttccattcattggctaaaattttgtctatttcatttaaacatggagaggatgttgcaaacaccttctagatgtttgaattatcaaatcgttcataaagattttaagtcccaactaatatatgatgctgatttttcaagttttttttatgtgcagaatgagagcgaactggtagaagcagttgatcgtgaccttagaaagatgctgataaagccaactgctgaggatcctcttcttgttggtgtaagagtatggccacaagctataccccagttcctggttggtcatcttgaccatctcgaggcagctaatgaagccctcaggaaaggaggttttggtggattttttcttggtggcaactatgtagctggtgtggcgttaggtagatgtgtggaaggtgcatatg

SEQ ID NO: 51 - DNA, 1559 bp, Commelina diffusa
ccatgctctaatagcttgtccgtcgtaatcttgggaatgaggtttttgaacgattgattgagccattctgttcaggtgcgcacaattcaattttcgctatgataagcaaaaaggtttttcacatgataattacctttgtttttttcttttggtgattaacatgcttttgtttgtaatgtcatatatatactatgttttacctagatatttgttttgaatttttttttcttctggatttttagttttctgcgttctttactccaaattgaatcagtttgtcataactgttatggcaattgttttgatcatgtttttaaaggagtctccctgttttatcatctagcttaggagtaccaaaatgagcatttatgttctctagaagttataggataagaaagacaggtgagaccttctggactgatttcacctaaaaaaatgctaaatctgcaggggtatatgctggagatcctacaaaacttagtatgaaggcagcttttggtaaagtatggaagttagaacagactggtggaagtattattgggggcactattaagacaatccaagatcaaaagaaaaatcccaaacctcctagagatccgtaagaatttcatgaaccaaattgggtttccatactacctgattgaaagtaatgaagtatccttgagttaattgttgctatttatcagacgcctaccaacaccaaaaggacaaacagttgcatcttttaggaaagggcttaacatgctacctgcagcaatttcttccaggtctttgttttttttcattctttgtaataccctgtaactatctgcaggcttttacaaactggttatactttttttttactttaccaagttggttagttagtagttatatttatgtgttcatactgaagatgagcaacttctgttttttatcataattatatttatatatttcttttgttatctatcaaggattatccttcagatctaacagttcacaaacttcactagcttgtatcttggaacatattttctttactttaatattttcattgacttgtatttcgtggaaaaacagactgggtagcaaagtgaaactatcatggaaacttgtgagcatcaggaagctggagagccaggaatatttattgctatatgaaacatcagaaggattgacttcagtacagactagaagtgttgttctgactgttccatcttatattgccagcaatctccttcgctctctttcagtaagcttatgccccactttaagcttctacagtccctttgaatatgtttatggaattctgttataaagaccttctcggttgctttttctgtagttaatttatgtggatggagaatctttctagaaattgttgacatgatactatatatggtatctatattgtgtgacatgttattgttgaccaatatatgctgttttcttgagttatctattccattgctctggaaatttctagatgttttatcatatcttacctatgttattttactgtcttaccatgacatatatatattttaattgtttattatgattaaagatatatatat

SEQ ID NO: 52 - DNA, 589 bp, Commelina diffusa
ttatgattaaagatatatatatccaattagtttacttccacattgcataatgtaccttgatatatatttcctactagcattttttccttaaaattacgatttttgtatgattatcagattaacaacactagcggcctcttttatattgatcctagtggaaggaggatattcctcctaatttgttgtactaagacatcggctacatttttttttttgcttatggagacatctatattaatatttgtggttcacatgattcttgttgcttaaagattatttaatggatggtggttgcagaatgacgcagctgatgctttgtcaaagttttactatcctccagttgctgctgtttccatttcatatccaaaggaagctattaggaacgaatgtttaatcgatggtgagcttaagggatttggccagttgcatccacgtagtcaaggagtagagacactcggtactgttctgtcttgtttatggccccacactactcaccccaaatataatataggttctatatgtatatgctctctggatttccatttgcaataacagaaatcatgcctagcaaataattatatagtcatga

SEQ ID NO: 53 - DNA, 876 bp, Digitaria sanguinalis
gacatcctgcgtccactttcaagtgatgctgcagatgccctttcaagattctattatccaccagttggtgctgtgactatttcatatccaaaggaagcaattagaaaggaatgcttgattgatggggagctccagggttttggccagttgcatccacgtagtcaaggagttgagacattaggaacaatatacagctcatcactcttcccaaatcgtgctcctgctggaagggtattacttctaaactatataggaggtgctacaaacactgggattgtctccaagagtgaaagtgagctggtagaagcagttgaccgtgaccttaggaaaatgctcatcaaccctagagcagtggaccctttagtccttggtgtccgagtgtggccacaagccatacctcagttcctggtaggacatcttgatcttctggaggttgcaaaatctgccttgggccgaggtggctatgatgggctcttcctaggagggaattatgtagcaggagttgccctgggccgatgcgtggagggtgcctatgaaagcgcctcgcaaatatctgacttcttgaccaagtatgcctacaagtgatgaaagaagtcgagctgctcgttgttttgcatagatgaggtgagaccaggagtggcacaaagtttacaaggattttttttttcatcttatttcgtaaattgtacttctgatctttttccctgttagtaattagttagactgtaggactctaagacatgctctgttcgccatcctagaaaggaagttttcttttaggttcatcaacgagatcatccatgcagactcgtgtagcgttttcctgtaaacactagttccaggaaatttaaatactctcttgcaagagcaaaaaaa

SEQ ID NO: 54 - DNA, 518 bp, Digitaria sanguinalis
acctaatgccatctcaaaaagcttgggtagcagagtgaaattatcatggaagctaataaatatctcaaagttggagaatagaggttataatttgacttacgaaacaccaaatggatttgcaagtctgcaaactaaaactgttgtcatgactgttccttcctacgtggcgagtgacttgttgcgtcctctttcgtcggaagcagctgaggctttgtccaaattttattaccctccagttgcagctgtatctgtttcctatccaaaagaggcgattcgtgctgaccgtttgatcgatggtcaacttaagggttttggtcaattacatccaagaagtcaaggcgttgagactttaggtaccatctatagttcatcccttttccctaaccgggcgccacctggaagggttctcctcctcaactacattggaggggctacaaatcctggtattttgtcaaagacagagagtgaacttgtggaagcagttgaccgtgatctaaggaagatgctcataaacccta

SEQ ID NO: 55 - DNA, 387 bp, Digitaria sanguinalis
tggaggattctttcaacgtcattttgggaaggaggttgttgagtatctcattgatccagttgttgcgggaacaagcggtggagatcctgaatcactttcaatgcgttatgcgtttcctgagttatgggatttagagagaaggttcggttcaatcatttctggggcatttctgtcaatgttatcttccagaggtgggaaaaggaaaccttctggaaacagcaaacgtaggcgtggttctttttcttttttgggtgggatgcagacgctcactgatgcactatgcaaagagattggaccccatgaatttaatctccaatcaaaggttcttgaaatgtcctacagctgcgatgataacgtggttggtaattggtcaatttattgtgctcc

SEQ ID NO: 56 - DNA, 2697 bp, Digitaria sanguinalis
cttgcgtctcacaaaaggcgcgagctggccggcccgctacttttgtgctttgtcttgtctccttcaggcttcagcaatggacaaacatccccctcaagtaaagcttaatagaaatcgattttgatgaacgaataaccatcattaacggcatcatggccatcgcttcgatgggatcagttgcttgcagagccggccaaagtgggcacgtgagagccacgaggatacgcgagatgacgacgaccatggaggtggtttcgaactttcgatcgccgatttttattgcgtcagtttcacagccagagatgcttggcctagtacggctgacgatgagcgtttgtttagctcatctgaaggaatgtgttttgcctgttgccaccaagattagcgtccttttcttttatcgaattcgggtcaccatttccactattaatcaaagatatagtttctatattttttctcattaatccacagtaccttttatttcagtagttattattgcatccatacttcaccagtacggcaccctttgcaatctctgcctacactccattacctcgaagaatagtgcactacagatgcaataaacacccacctcaccgactgctcgtaggtgcaccagtacactacatttgctgctgcatgctggtcgccatcatccttcctgcctgcaggaagcagcagggtgtctgggatctgcatcatgccgggcgcacaagaggaacagacgtgccaataaaagggctagcaacgcaacgaggggagggcccctttttttcgtgttacctcccgtcctgtgcatgagttgtcgtgtgtaacagacgtgcttggtgataaagcgtaggtgaagaagtggcctcccctgtgtcccctcccttctcaggaacgtttcgtcatcttttcactgaaaacgggcgcgtgctaactgccgcatctgtgagttgaatggttgattggagagaaattaggtgtgcaatcaccacttgggcggcaatcgtgtgcacttacttttggttgggtgtcagatcaacaacaggggtttcttggggaaatgtttccaaatgtacttctcaaaattacttctagtgtacacatgttgaatttcagttcaaatttatttacaagaataataaacaaagaagaaaattggcaaacaacattcataaaaaatggaatgaaaagagaaatgcatccttcttttgaagataaatagtcaaatgccatgtttgtttcgttcacaaacagaaaaatgatttcatgattgcaccgcaagagtggatgaatatatataggtctacagttgaacaccaatttggaagaaaaattcatgaggcagaagtaaaatcgattatttccttgagcttccgcattgcatctcccaaaagaaaaccattaaatactactagcaagttctagtacagtccctactaattaaacatcagcataattatccttcttatactcactcgggttttttcttatatgtcgtattagtttcatcttaagtcaaacttgtcaaaatttgaccaagtttatacaaaagtataacaataactatactaccaaacttatatggtatcacaatatatttcattagtagggactgtctcgccggtcggggaaattaaacgccccccgatccgtcaccgtgacctgccctcctccccgcccgggcagatcgggccatcgcctccatcggggcacggctaggtacctgaaaacgatcgagcaaagcggccggttcgtttcgttcgtagcgagaggcatttgctgccagttcccggcgcgggacacgcgcgcgcgaaatggcggtgtcgagagggagggaggcgtcgctttcggcgggcgggggcgtgttccctggctgtagcccggcggcgcggcaggcctcgcgcgggtgtcaataccggcccggcggattaggtccccgtctttatgaccggcgcgcgcgcacccttgcggtgcccgtgcgttgacgacgctgccaccgcacgtcccccttcttcattccatggcagggacgacgacgctagctatagctgcacgtacgcggtcgatcgagtggctatggcttggtctctactgcacgccatgccgcccggcctcccaccacaataactcgtgtgccggcccggcacggcgcgggccgtggtggaactgatcgcgtcgcgcattgatcatcatgcgtgggggcgtcggggcgacggctcgagcgtgcgcacatgattgtgcgtgtcaggatcccagacgctagctacagcttgctgctggtccatccagtgccctacgtggacgccgatcgctgtgtgttggtgtgtggggtgatgatgatggcggatggatggagtcatggaggcactgcggggctcacaggagattttggtgggtggtggacgcatccgtcgcgtcgcccccggcgctcgagtgcaccccgtaccaacccaacacgtccgctgtcgtggagacgccggagggcgcatgaaatcattgttaattttctcttgtgtgttttttttaaaaaaattataataacaaaagatgcatgctcccttcttctttgattaactaatcgatcagctagctaactcacacattgtccttcctgcaagtagcgcatgtatatttatgctcaactatatgggtatatactttttttaaaaaaaacataatcaactatatatatgggttatatgtgggcga

SEQ ID NO: 57 - DNA, 1089 bp, Digitaria sanguinalis
taggtatttctttcaactgagtcttaagctacaacatctacagattattgtttttcttttgtggtgtgatttttcattctagtatgtattatgtcttcttttgttgaatccaagatatgaatcaaaatagtggtggtatgcttttgtaggaacaatatacagctcatcactcttcccaaatcgtgctcctgctggaagggtgttacttctaaactatataggaggtgctacaaacactggaattgtttccaaggttagtaattctctgtcgaacttattgccttgagttttgtgttcatgatgttttgactgtaaaaagaaaattggcattctttaataatcaacgtaagcagtattttaaaaagaaagttggcattttaataatcaatatcaacttgtaactagattgcttattattggctattattatttaggtgggacccgcagactatttaggtgtggaacccatgtgggacccgcatactatttaggcgggacccacgcatattcagacacactatttagagtggaacctacaataatgttaagcgtctacgttatttaaaaaattattgataattgttttcattctttgcagtataaaatatatttatttttttctatgtataaaaataatctctaactttgtatactacattcgtttgtgatagttctaatactttttgtactttgctttcatttcataaatttgaaaaataagattgaattatacattcgttacaaaatgtatcttttttctattaaaaattaaaaattagtgtaacataacacgtcactccattagctatttctactaccacttatatagtgcttaaatgattattatgattaaaaaatttgtctaaatttaatattgcattgagtatagtaagataacaaatttgtattacatcattattttagtttaacatcttctatatagacgcacatcgctcgtcaacccaactagtattcctaatgatgccatctcaattgcagagtgaaagtgagctggtagaagcagttgatcgtgacctcaggaaaatgctcatcgaccctagagcagtggaccctttagtccttggtgtc

SEQ ID NO: 58 - DNA, 1518 bp, Kochia scoparia
atacactgctctacaatctcaacctcaactccaacctcaagttcaaacccaggaacacttggcgaaggaggattattggattgtgtgatcgtgggaggtggtattagtgggctctgcattgcacaagcactttctacaaagtactcttctctttctacaaatttcattgttaccgaggcgaaagatcgagttggtggcaacattaccaccaaggaggatgatggctatatctgggaagaaggacccaacagttttcagccgtctgatgcagttctcaccatggctgttgattgtgggttgaaagatgaattggtgtttggtgaccccaaagcacctcgatttgtgctgtggaatgggaaattaaggcgggtaccttctaagctcacagatctccctttctttgatcttatgagctttcctggcaagattagagctggccttggcgctcttggatttcgtccttctccaccaggtcgtgaagaatctgttgaggattttgttcgtcgaaatcttggcgatgaggtctttgaacgtttgattgaacctttttgttcaggtgtgtatgctggtgatcctgccaagttaagcatgaaagctgcttttggcagagtgtgggttttggagcagatgggtggtaatatcattggtggcgctctcaaaactatccaggaaaagaagaataagcctaagccgcctcgagatccgcgccttccgaagccaaagggtcagacagttggatcctttaggaaaggactcattatgttgccgaacgccatttctgctaggcttggaagtaaagtgaaactttcttggactctagctagtatttctaagacacacaatggggaatataatttgatttatgatacaccagatggaccggtttccgtaaggactaaaagtatcgtgatgactattccatcatatgttgcaagtagtctgcttcgtccattctcagatgctgctgcagattccctttcaaaatttcactatccacctgttgcagcagtgtcactgtcttatcctgaagaagcgattagacctgagtgcttgattgatggtaaacttcaaggattcgggcaactgcatccccgcagtcagggtgtggaaaccttgggatcaatttatagttcatctcttttccctggtcgagcaccacctggtaggaccatgatcttgagcttcattggaggtgctactaatcctggcatagtagacaagacgcaagatgaacttgctaagactgttgacaaggacctgagaagaattcttataaatccaagtgcaaaagatcctcgtgttctaggcgtgaaagtatggcctcaagcaataccccaatttttgataggccactttgatctgcttgatgctgcaaaagctgctttgactgatgctgggtgtaaaggattgtttcttggaggaaactatgtatcaggtgttgccttggggcggtgtatagagggtgcttatgaatctgcagccgaggtagttgatttcctctcccagtattcagacaaa

SEQ ID NO: 59 - DNA, 963 bp, Kochia scoparia
atacactgctctacaatctcaacctcaactccaacctcaagttcaaacccaggaacacttggcgaaggaggattattggattgtgtgatcgtgggaggtggtattagtgggctctgcattgcacaagcactttctacaaagtactcttctctttctacaaatttcattgttaccgaggcgaaagatcgagttggtggcaacattaccaccaaggaggatgatggctatatctgggaagaaggacccaacagttttcagccgtctgatgcagttctcaccatggctgttgattgtgggttgaaagatgaattggtgtttggtgaccccaaagcacctcgatttgtgctgtggaatgggaaattaaggcgggtaccttctaagctcacagatctccctttctttgatcttatgagctttcctggcaagattagagctggccttggcgctcttggatttcgtccttctccaccaggtcgtgaagaatctgttgaggattttgttcgtcgaaatcttggcgatgaggtctttgaacgtttgattgaacctttttgttcaggtgtgtatgctggtgatcctgccaagttaagcatgaaagctgcttttggcagagtgtgggttttggagcagatgggtggtaatatcattggtggcgctctcaaaactatccaggaaaagaagaataagcctaagccgcctcgagatccgcgccttccgaagccaaagggtcagacagttggatcctttaggaaaggactcattatgttgccgaacgccatttctgctaggcttggaagtaaagtgaaactttcttggactctagctagtatttctaagacacacaatggggaatataatttgatttatgatacaccagatggaccggtttccgtaaggactaaaagtatcgtgatgactattccatcatatgttgcaagtagtctgcttcgtccattctcagtgagt

SEQ ID NO: 60 - DNA, 564 bp, Kochia scoparia
caggatgctgctgcagattccctttcaaaatttcactatccacctgttgcagcagtgtcactgtcttatcctgaagaagcgattagacctgagtgcttgattgatggtaaacttcaaggattcgggcaactgcatccccgcagtcagggtgtggaaaccttgggatcaatttatagttcatctcttttccctggtcgagcaccacctggtaggaccatgatcttgagcttcattggaggtgctactaatcctggcatagtagacaagacgcaagatgaacttgctaagactgttgacaaggacctgagaagaattcttataaatccaagtgcaaaagatcctcgtgttctaggcgtgaaagtatggcctcaagcaataccccaatttttgataggccactttgatctgcttgatgctgcaaaagctgctttgactgatgctgggtgtaaaggattgtttcttggaggaaactatgtatcaggtgttgccttggggcggtgtatagagggtgcttatgaatctgcagccgaggtagttgatttcctctcccagtattcagacaaa

SEQ ID NO: 61 - DNA, 516 bp, Kochia scoparia
gtaacttgcctacccctctcagttataattactacattcaagaaggttaatgtgaaaagacctcttgagggctttggagttcttgtcccctctgttgagcagaaaaatgggttgaagactcttggtacactattttcctccatcatgtttcctgatcgtgctccctctgatgtgtatctctatacaacctttgttggtggaagcaggaatagtgaacttgcaaaagcttcaacggatgagctgaagcaaatagtttcttctgaccttgagaagctattgggcactgagggtgaacctacctctgtgaatcatttctattggagcaaggcattccctctttatgggcgcaactatgactcagtactcaaagcaatcgagcagatggaaagagatcttcgtggacttttttatgcaggcaaccataaagatggactttccgtgggaaaagctataacatcgggacacaaagctgcggagcttgtaatgttgtatctcaactcttcattagatgcaaag

SEQ ID NO: 62 - DNA, 1185 bp, Lolium multiflorum
gagcgcctcatcgagccttctgctcaggtgtgtatgcgggtgacccttcaaagctcagtatgagggctgcgtttgggaaggtatggagactggaggagaatggaggcagtattattggtggaaccatcaaggcaattcaggatagaggcaagaaccccaaaccgccgagggatccccgacttccgacaccaaaggggcagacggtggcatctttcaggaagggtctagccatgctcccaaatgctatcgcttctaggttgggtagtaaagtcaaactctcgtggaagcttacgggcattacaaagtcggacaaccagggatatgtgttagcgtatgaaacaccggaaggagttgtttcagtgcaggctaaaagtgttatcatgaccattccgtcatatattgctagtgaaatcttgcgcccactttcgagtgatgcagcagatggtctctcaaaattttattatccaccggttgctgctgtaactgtttcatatccaacagaagctattagaaagaatgcttaattgatggggagctccagggtttcggccagttgcatccacgtagccaaggagttgagactttagggacaatatatagctcttctctctttccgaatcgtgctcctgctggaagagtgttacttctgaactatatcgggggtgctacaaatacagggatcgtctccaagactgagagtgacttggtggaagcagttgatcgtgacctcagaaaaatgttgataaatcctacagcaccagaccctttagccttaggcgtccgagtgtggccacaagccattccacagtttttgattgggcaccttgatcgccttgatgcggcaaaatctgccttggccagaggcggctgcagtgggttgtttctaggaggaaactatgtagcaggagttgccttgggccgatgcatcgagggtgcgtacgagagtgcctcagaagtatctgacttcttgaccaagtatgcctacaagtgatgaaagaagtgtaattcatcatcttgctgcatatttgaggtgcggccagaattagtaataattcggaaaatcttgtaatcttctctacttatacctcctatcgttttcctaatcgcaatttagttagaagttaggtttgtagaagaaattttactagttgttcagtataattctttcagattttggtgatgcaa

SEQ ID NO: 63 - DNA, 258 bp, Lolium multiflorum
ttgaaacaacttgtgacctctgaccttagaaagctcttgggtgtagaggggcagccaacttttgtgagacatatacattggaaaaatgcttttcctctgtatggccatgattatgatttggcattggaagctataggaaagatggagaatgatcttccagggttcttctatgcaggaaataacaaggatggcttggctgttggaaatgttatagcttcaggaagtaaaactgctgatctggtgatctcgtatcttgag

SEQ ID NO: 64 - DNA, 201 bp, Lolium multiflorum
ttgatatttattatgcaggtggattatctgccgttatccctcatggtaacagcttttaagaaggaagatgtcaaaagacccctggaaggatttggggtgttggtaccctataaggaacagcaaaaacatggtctgaaaacccttggaaccctcttctcctctatgatgttcccagatcgagctcctaatgaccaacactta

SEQ ID NO: 65 - DNA, 150 bp, Lolium multiflorum
aatcctgccttattggtatttattatgcaggtggattatctgccgttatccctcatggtaacagcttttaagaaggaagatgtcaaaagacccctggaaggatttggggtgttggtaccctataaggaacagcaaaaacatggtctgaaa

SEQ ID NO: 66 - DNA, 144 bp, Lolium multiflorum
agtgttgggagcttctttgaacgccattttggaaaggaagttgtcgactatcttattgatccatttgtagctggaacaagtgcaggagatcctgagtcattatctatccgtcatgcatttccagcgttatggaatttagaaaag

SEQ ID NO: 67 - DNA, 114 bp, Lolium multiflorum
ataggaaccctcttctcctctatgatgttcccagatcgagctcctaatgaccaacacttatttacaacattcgttgggggaagccacaatagggatctcgctggagctccaacg

SEQ ID NO: 68 - DNA, 108 bp, Lolium multiflorum
agggtggccatcatcggcgccggcgtgagcggcctggcggcgtgcaagcacctgctggagcgcggctgccggcccgtcgtcttcgaggcggacacgctccttggcggt

SEQ ID NO: 69 - DNA, 3037 bp, Lolium multiflorum
ctcgacgcgaacgcgggatctctttcgcgtcaggcgtgaaatagggccggatttccatatacaactactaaccgagaaccccgcccactggaatgcgattcccagcccatcgacctatccaattccaattccagtgggccatgaaaaccgcaaaccaaccaaccaatacagccgcagccgcatcccgtcatccactccgcactgccatctcccccgcccgagcgacggaaatggtcggcgcaaccatggccaccgctaccgtcacggcggcgctaccgctccgcctccgggtccccgcgcgcccccgacgcggacagacgcgctgcgcggtcgcgagcgatgccaccgaggcgccggccgtgcccagcgcacggctgtccgcggattgcgtcatcgtgggcggcggcatcagcggcctctgcaccgcacaggcgctggccaccaagtacggcgtcaccgacttgctcgtcacggaggcccgcgctcgcgcaggcggcaacatcaccaccgtcgagcgccccgacgaggggtacctctgggaggagggccccaacagcttccagccctccgaccccgtcctcaccatggccgtacgcaccatgctcgctttctccttcttttccggattcttcgggacgtaggcgtacagaatacagatacgatcgctgaatggattggttgcgcaggtagacagcgggctcaaggatgacttggtgttcggggaccccaatgcgccgcgcttcgtgctgtggcaggggaagctgaggccggtgccgtccaagcctggcgacctgcctttcttcgacctcatgagtattcctgggaagctcagggccggccttggcgcgctcggcattcgtccgcctcctccagtttgtgctctgcccgtgctctctattctttagtgaattttgattgtcaaagatggggctgagcgttcccggcgaaggtttcaggggcgtgaggagtcggtggaggagtttgtgcgccgcaacctcggcgcggaggtctttgagcgcctcatcgagcctttctgctcaggtaatgtgcagtagtatatgtctgttctgttctgctctgcttcttgcattgatcccgataataagaatataacatttcgatatcaacgttaggtgtgtatgcgggtgacccttcaaagctcagtatgcgggctgcatttgggaaggtatggagactggaggagaatggaggcagtattattggtggaaccatcaaggcaattcaggatagaggcaagaaccccaaaccaccgagggatccgtaagtggagactctacttttctatttagtcagttaactcactgttccattagactcgtattaatctgtttcaccacttttagccgacttccgacaccaaaggggcagacggtggcatctttcaggaagggtctagccatgctcccaaatgctatcgcttctaggtttgttttcatcacttgtgcacatacctaagttatgctatcagtatacgtggtgctgtatattgttcagatagaggggacagatctgttggtagacctactgtttgctgaactcaataccatatgaatatcattgcatcagcacccaaagtacctgtggctcgattattatatcagccattctcgcattgttgatactaatgcatctgtgttaatctttttcatcttgcttttttggttgggacctgtactatataggaaattccacgagggatgagttatagagcatgtgtgtgtatgtccatgccccttgtactcggagatgatcatgaattatagtaataatttcatgcttggtcttaagacgtaaccctgtcatgttttgcattccttcatttccaggttgggtagtaaagtcaaactctcgtggaagcttacgggcattacaaagtcggacaaccagggatatgtgttagcgtatgaaacaccggaaggagttgtttcagtgcaggctaaaagtgttatcatgaccattccgtcatatattgctagtgaaatcttgcgcccactttcggtaagttcatgtttgcaaaattaattggtgtactactaatgttagtgttaggttcctgtagttctccatactcctgtgcagtggcggacccaggattttggcaaagggtatgccacacaaaaaaattggcctgccttgataacgattttttcttagaatatgaagtagaagtgatgattatgaaatatgattgaaaaaatcaaataaaagtgttcttgcattataatcaaaatattaaattgcttaacacatgcacggtttgcgaggtgtcctattttttaaactaatttctcaccgtaccatctgaccctaaatttctgaagtatttgaccacggaataatcgtttcagcaacactacaagataacgttagatcgtactaaataaacaaagaaatatgctgaagaaagctacaacggagcatataaaaattagtcacaatagctaaatggtttcttaattaatcaccatagctaatcatccattacgaaagtacctggacgcatgcatggtgcatggccatgtctctaggctagtttagcaattaaccggatggtcaagtgagtaccaaaaactaataaagcatgtgtccctgtacgatgcatgctcgcaggctacatgcaccggcttgattaaaatggccagctgattacaggcggttcatatggctgggccgctaggtatgccatggcatatgcggcataccctgtaggtccgcactgctcctgtggtaaccatgaaatagcacgctagtacactattccttaatagagttgctaatcaataattgaccgcattacgatactggttgcctgtaatcttagtccaaacacatgattgagcatttttgttgagagattaattgattaatgtggttaaactgttcactgatgcataggttggactatttcttcaccaatcaactctatgtttcaaataattgaaatatacatcaatagattcagaaaactgtatcttgttttgacaaagtgacgcaagacaccaatatgccttatgat

SEQ ID NO: 70 - DNA, 795 bp, Lolium multiflorum
ggttttggtattattctactaataattcgtggcatttttatgtagggacaatatatagctcttctctctttccaaatcgtgctcctgctggaagagtgttacttctgaactatatcggtggtgctacaaatacagggatcgtctccaaggttctctcgacctgctggatactcatgtcattttcttattgcgtgataccaggttacagtattcagttagtgttggtcacctattcatttatgattaatataaataactggactgcatttttcacccccagctgcaattgtgaatacaaatagattaaatggtctgcttagatgctacattcaatctcaatagtattgttagattttttttttggctggccatatttatactgatcccattttgtttgcagactgagagtgacttggtggaagcagttgatcgtgacctcagaaaaatgttgataaatcctacagcaccagaccctttagccttaggtgtccgagtgtggccacaagccattccacagtttttgattgggcaccttgatcgccttgatgcggcaaaatctgccttggccagaggcggctgcagtgggttgttcctaggaggaaactatgtagcaggagttgccttgggccgatgcatcgagggtgcgtacgagagtgcctcagaagtatctgacttcttgaccaagtatgcctacaagtgatgaaagaagtgtaattcatcatcttgctgcatatttgaggtgcggccagaatcagtaataattcggaaaatcttgtaatcttctctacttatacc

SEQ ID NO: 71 - DNA, 381 bp, Lolium multiflorum
tcaggggcgtgaggagtcggtggaggaatttgtgcgccgcaacctgggtgcggaggtctttgagcgcctcatcgagcctttctgctcaggtagtgtgcagtagtatctgtctgttctgttctgctctgcttcctgcattgattccgataataagaatataacatttcgatatcaacgttaggtgtgtatgcgggtgacccttcaaagctcagtatgcgggctgcgtttgggaaggtatggagactggaggagaatggaggcagtattattggtggaaccatcaaggcaattcaggatagaggcaagaaccccaaaccgccgagggatccgtaagtggagactgcaattttctatttagtcagttaactgttccattagact

SEQ ID NO: 72 - DNA, 200 bp, Amaranthus albus
ggaatccttgatttgaagataggataaccagagagagtgcgagagagatgagtgcgatggcgttatcgagcagcattctacaatgtccgccgcactccgacatctcgttccgcttttttgctcatacacgaacccactcccccatcttcttcagaagaccacgaaaattatcatatatccattgttccacaagctcaagc

SEQ ID NO: 73 - DNA, 200 bp, Amaranthus albus
gcttgagcttgtggaacaatggatatatgataattttcgtggtcttctgaagaagatgggggagtgggttcgtgtatgagcaaaaaagcggaacgagatgtcggagtgcggcggacattgtagaatgctgctcgataacgccatcgcactcatctctctcgcactctctctggttatcctatcttcaaatcaaggattcc

SEQ ID NO: 74 - DNA, 200 bp, Amaranthus albus
tatccattgttccacaagctcaagctcaactgccaattaccagaacacgattacgagccaaggagaaggagaaaaagtattagattgtgtaattgttggagctggtatcagtggactttgcattgctcaggctctttctaccaaacacattcaatccaatctcaatttcattgtcactgaagctaaacatcgtgttggag

SEQ ID NO: 75 - DNA, 200 bp, Amaranthus albus
ctccaacacgatgtttagcttcagtgacaatgaaattgagattggattgaatgtgtttggtagaaagagcctgagcaatgcaaagtccactgataccagctccaacaattacacaatctaatactttttctccttctccttggctcgtaatcgtgttctggtaattggcagttgagcttgagcttgtggaacaatggata

SEQ ID NO: 76 - DNA, 200 bp, Amaranthus albus
actgaagctaaacatcgtgttggaggtaatatcactaccatggagtccgatggctatatctgggaagagggtcctaatagtttccaaccctccgatcctgtgcttactatggcggttgacagtggattgaaagacgatttggtcttgggagatcctaatgcccctcgtttcgtgctgtggaatggtaaattaaggcctgt

SEQ ID NO: 77 - DNA, 200 bp, Amaranthus albus
acaggccttaatttaccattccacagcacgaaacgaggggcattaggatctcccaagaccaaatcgtctttcaatccactgtcaaccgccatagtaagcacaggatcggagggttggaaactattaggaccctcttcccagatatagccatcggactccatggtagtgatattacctccaacacgatgtttagcttcagt

SEQ ID NO: 78 - DNA, 200 bp, Amaranthus albus
tgtggaatggtaaattaaggcctgttccttccaaacctacggaccttcccttttttgatctcatgagctttcctggtaagattagggctggtcttggtgcacttggtcttcgtcctcctcctcctccttcttcttatgaggaatccgttgaagaatttgtgcgccgtaatctcggcgatgaggtcttcgaacgcttgatt

SEQ ID NO: 79 - DNA, 200 bp, Amaranthus albus
aatcaagcgttcgaagacctcatcgccgagattacggcgcacaaattcttcaacggattcctcataagaagaaggaggaggaggaggacgaagaccaagtgcaccaagaccagccctaatcttaccaggaaagctcatgagatcaaaaaagggaaggtccgtaggtttggaaggaacaggccttaatttaccattccaca

SEQ ID NO: 80 - DNA, 200 bp, Amaranthus albus
cgatgaggtcttcgaacgcttgattgaacccttttgttctggtgtctatgctggtgatcctgcaaagttgagtatgaaagctgcatttggaaaggtctggaccttagagcaaaagggtggtagtatcatcgccggtacactcaaaactattcaggaaaggaagaataatcctccaccccctcgagacccccgccttccta

SEQ ID NO: 81 - DNA, 200 bp, Amaranthus albus
taggaaggcgggggtctcgagggggtggaggattattcttcctttcctgaatagttttgagtgtaccggcgatgatactaccacccttttgctctaaggtccagacctttccaaatgcagctttcatactcaactttgcaggatcaccagcatagacaccagaacaaaagggttcaatcaagcgttcgaagacctcatcg

SEQ ID NO: 82 - DNA, 200 bp, Amaranthus albus
ccccctcgagacccccgccttcctaaacctaagggccagactgttggatcctttaggaaaggactcattatgttacctaccgccattgctgctaggcttggcagtaaagtcaaactatcgtggacactttctaatattgataagtcgctcaatggtgaatacaatctcacatatcaaacacccgatggaccggtttctgt

SEQ ID NO: 83 - DNA, 200 bp, Amaranthus albus
acagaaaccggtccatcgggtgtttgatatgtgagattgtattcaccattgagcgacttatcaatattagaaagtgtccacgatagtttgactttactgccaagcctagcagcaatggcggtaggtaacataatgagtcctttcctaaaggatccaacagtctggcccttaggtttaggaaggcgggggtctcgaggggg

SEQ ID NO: 84 - DNA, 200 bp, Amaranthus albus
taggaccttgatcttgagctacattggaggtgctacaaatcttggcatattacaaaagagtgaagatgaacttgcggagacagttgataaggatctcagaaaaattctgataaatccaaatgcgaaaggcagccgtgttctgggagtgagagtatggccaaaggcaatcccccaatttttagttggtcactttgatctgc

SEQ ID NO: 85 - DNA, 200 bp, Amaranthus albus
gcagatcaaagtgaccaactaaaaattgggggattgcctttggccatactctcactcccagaacacggctgcctttcgcatttggatttatcagaatttttctgagatccttatcaactgtctccgcaagttcatcttcactcttttgtaatatgccaagatttgtagcacctccaatgtagctcaagatcaaggtccta

SEQ ID NO: 86 - DNA, 200 bp, Amaranthus albus
tttttagttggtcactttgatctgctagatgctgcaaaagctgctttggcaaatgctgggctaaaggggttgtttcttggtggtaattatgtatcaggtgttgccttggggaggtgtatagagggtgcttatgactctgcatctcaggtagtggatttcctctcacagtacaaagacaagtagtcagtagggctccagca

SEQ ID NO: 87 - DNA, 200 bp, Amaranthus albus
tgctggagccctactgactacttgtctttgtactgtgagaggaaatccactacctgagatgcagagtcataagcaccctctatacacctccccaaggcaacacctgatacataattaccaccaagaaacaacccctttagcccagcatttgccaaagcagcttttgcagcatctagcagatcaaagtgaccaactaaaaa

SEQ ID NO: 88 - DNA, 200 bp, Amaranthus graecizans
gtgcgagagagatgagtgcgatggcgttatcgagcagcattctacaatgtccgccgcactccgacatctcgttccgcttttttgctcatacacgaacccactcccccatcttcttcagaagaccacgaaaattatcatatatccattgttccacaagctcaagctcaactgccaattaccagaacacgattacgagccaa

SEQ ID NO: 89 - DNA, 200 bp, Amaranthus graecizans
ttggctcgtaatcgtgttctggtaattggcagttgagcttgagcttgtggaacaatggatatatgataattttcgtggtcttctgaagaagatgggggagtgggttcgtgtatgagcaaaaaagcggaacgagatgtcggagtgcggcggacattgtagaatgctgctcgataacgccatcgcactcatctctctcgcac

SEQ ID NO: 90 - DNA, 200 bp, Amaranthus graecizans
ttaccagaacacgattacgagccaaggagaaggagaaaaagtattagattgtgtaattgttggagctggtatcagtggactttgcattgctcaggctctttctaccaaacacattcaatccaatctcaatttcattgtcactgaagctaaacatcgtgttggaggtaatatcactaccatggagtccgatggctatatct

SEQ ID NO: 91 - DNA, 200 bp, Amaranthus graecizans
agatatagccatcggactccatggtagtgatattacctccaacacgatgtttagcttcagtgacaatgaaattgagattggattgaatgtgtttggtagaaagagcctgagcaatgcaaagtccactgataccagctccaacaattacacaatctaatactttttctccttctccttggctcgtaatcgtgttctggtaa

SEQ ID NO: 92 - DNA, 200 bp, Amaranthus graecizans
accatggagtccgatggctatatctgggaagagggtcctaatagtttccaaccctccgatcctgtgcttactatggcggttgacagtggattgaaagacgatttggtcttgggagatcctaatgcccctcgtttcgtgctgtggaatggtaaattaaggcctgttccttccaagcctacggaccttcccttttttgatct

SEQ ID NO: 93 - DNA, 200 bp, Amaranthus graecizans
agatcaaaaaagggaaggtccgtaggcttggaaggaacaggccttaatttaccattccacagcacgaaacgaggggcattaggatctcccaagaccaaatcgtctttcaatccactgtcaaccgccatagtaagcacaggatcggagggttggaaactattaggaccctcttcccagatatagccatcggactccatggt

SEQ ID NO: 94 - DNA, 200 bp, Amaranthus graecizans
ctacggaccttcccttttttgatctcatgagctttcctggtaagattagggctggtcttggtgcacttggtcttcgtcctcctcctcctccttcttcttatgaggaatccgttgaagaatttgtgcgccgtaatctcggcgatgaggtcttcgaacgcttgattgaacccttttgttctggtgtctatgctggtgatcct

SEQ ID NO: 95 - DNA, 200 bp, Amaranthus graecizans
aggatcaccagcatagacaccagaacaaaagggttcaatcaagcgttcgaagacctcatcgccgagattacggcgcacaaattcttcaacggattcctcataagaagaaggaggaggaggaggacgaagaccaagtgcaccaagaccagccctaatcttaccaggaaagctcatgagatcaaaaaagggaaggtccgtag

SEQ ID NO: 96 - DNA, 200 bp, Amaranthus graecizans
ttctggtgtctatgctggtgatcctgcaaagttgagtatgaaagctgcatttggaaaggtctggaccttagagcaaaagggtggtagtatcatcgccggtacactcaaaactattcaggaaaggaagaataatcctccaccccctcgagacccccgccttcctaaacctaagggccagactgttggatcctttaggaaag

SEQ ID NO: 97 - DNA, 200 bp, Amaranthus graecizans
ctttcctaaaggatccaacagtctggcccttaggtttaggaaggcgggggtctcgagggggtggaggattattcttcctttcctgaatagttttgagtgtaccggcgatgatactaccacccttttgctctaaggtccagacctttccaaatgcagctttcatactcaactttgcaggatcaccagcatagacaccagaa

SEQ ID NO: 98 - DNA, 200 bp, Amaranthus graecizans
cagactgttggatcctttaggaaaggactcattatgttacctaccgccattgctgctaggcttggcagtaaagtcaaactatcgtggacactttctaatattgataagtcgctcaatggtgaatacaatctcacatatcaaacacccgatggaccggtttctgttaggaccaaagcggttgtcatgactgtcccttcata

SEQ ID NO: 99 - DNA, 200 bp, Amaranthus graecizans
tatgaagggacagtcatgacaaccgctttggtcctaacagaaaccggtccatcgggtgtttgatatgtgagattgtattcaccattgagcgacttatcaatattagaaagtgtccacgatagtttgactttactgccaagcctagcagcaatggcggtaggtaacataatgagtcctttcctaaaggatccaacagtctg

SEQ ID NO: 100 - DNA, 200 bp, Amaranthus graecizans
cggttgtcatgactgtcccttcatacattgcaagtagcctgcttcgtccgctctcagatgttgctgcagattctctttctaaattttactatcctccagtcgcagcagtgtccctttcttatcccaaagaagcaattagaccagaatgcttgatcgatggagaactaaaaggattcgggcaattgcatccccgcagccag

SEQ ID NO: 101 - DNA, 200 bp, Amaranthus graecizans
ctggctgcggggatgcaattgcccgaatccttttagttctccatcgatcaagcattctggtctaattgcttctttgggataagaaagggacactgctgcgactggaggatagtaaaatttagaaagagaatctgcagcaacatctgagagcggacgaagcaggctacttgcaatgtatgaagggacagtcatgacaaccg

SEQ ID NO: 102 - DNA, 200 bp, Amaranthus graecizans
cgggcaattgcatccccgcagccagggtgtggaaaccttgggaacaatttatagttcatctcttttccctggtcgagcaccacccggtaggaccttgatcttgagctacattggaggtgctacaaatcttggcatattacaaaagagtgaagatgaacttgcggagacagttgataaggatctcagaaaaattctgataa

SEQ ID NO: 103 - DNA, 200 bp, Amaranthus graecizans
ttatcagaatttttctgagatccttatcaactgtctccgcaagttcatcttcactcttttgtaatatgccaagatttgtagcacctccaatgtagctcaagatcaaggtcctaccgggtggtgctcgaccagggaaaagagatgaactataaattgttcccaaggtttccacaccctggctgcggggatgcaattgcccg

SEQ ID NO: 104 - DNA, 200 bp, Amaranthus graecizans
aaggatctcagaaaaattctgataaatccaaatgcgaaaggcagccgtgttctgggagtgagagtatggccaaaggcaatcccccaatttttagttggtcactttgatctgctagatgctgcaaaagctgctttggcaaatgctgggctaaaggggttgtttcttggtggtaattatgtatcaggtgttgccttggggag

SEQ ID NO: 105 - DNA, 200 bp, Amaranthus graecizans
ctccccaaggcaacacctgatacataattaccaccaagaaacaacccctttagcccagcatttgccaaagcagcttttgcagcatctagcagatcaaagtgaccaactaaaaattgggggattgcctttggccatactctcactcccagaacacggctgcctttcgcatttggatttatcagaatttttctgagatcctt

SEQ ID NO: 106 - DNA, 200 bp, Amaranthus graecizans
atgtatcaggtgttgccttggggaggtgtatagagggtgcttatgactctgcatctcaggtagtggatttcctctcacagtacaaagacaagtagtcagtagggctccagcatcctggttaagtaactttttgtagctgttgtaattcagatataaaatagcccacagtcaaacaagtttggaaagatgtaaaagcatga

SEQ ID NO: 107 - DNA, 200 bp, Amaranthus graecizans
tcatgcttttacatctttccaaacttgtttgactgtgggctattttatatctgaattacaacagctacaaaaagttacttaaccaggatgctggagccctactgactacttgtctttgtactgtgagaggaaatccactacctgagatgcagagtcataagcaccctctatacacctccccaaggcaacacctgatacat

SEQ ID NO: 108 - DNA, 200 bp, Amaranthus hybridus
gaagctaaacatcgtgttggaggtaatatcactaccatggagtccgatggctatatctgggaagagggtcctaatagtttccaaccctctgatcctgtgcttactatggcggttgacagtggattgaaagacgatttggtcttgggagatcctaatgcccctcgtttcgtgctctggaatggtaaattaaggcctgttcc

SEQ ID NO: 109 - DNA, 200 bp, Amaranthus hybridus
ggaacaggccttaatttaccattccagagcacgaaacgaggggcattaggatctcccaagaccaaatcgtctttcaatccactgtcaaccgccatagtaagcacaggatcagagggttggaaactattaggaccctcttcccagatatagccatcggactccatggtagtgatattacctccaacacgatgtttagcttc

SEQ ID NO: 110 - DNA, 200 bp, Amaranthus hybridus
ggaatggtaaattaaggcctgttccttccaaacctacggaccttcccttttttgatctcatgagctttcctggtaagattagggctggtcttggtgcacttggtcttcgtcgtcctcctcctccttcttcttatgaggaatctgttgaagaatttgtgcgccgtaatctcggcgatgaggtcttcgaacgcttgatcgaa

SEQ ID NO: 111 - DNA, 200 bp, Amaranthus hybridus
ttcgatcaagcgttcgaagacctcatcgccgagattacggcgcacaaattcttcaacagattcctcataagaagaaggaggaggaggacgacgaagaccaagtgcaccaagaccagccctaatcttaccaggaaagctcatgagatcaaaaaagggaaggtccgtaggtttggaaggaacaggccttaatttaccattcc

SEQ ID NO: 112 - DNA, 200 bp, Amaranthus hybridus
tgaggtcttcgaacgcttgatcgaacccttttgttctggtgtgtatgctggtgatcctacaaagttgagtatgaaagctgcatttggaaaggtctggaccttagagcaaaagggtggtagtatcatcgccggtacactcaaaactattcaggaaaggaagaataatcctccaccccctcgagacccccgccttcctaaac

SEQ ID NO: 113 - DNA, 200 bp, Amaranthus hybridus
gtttaggaaggcgggggtctcgagggggtggaggattattcttcctttcctgaatagttttgagtgtaccggcgatgatactaccacccttttgctctaaggtccagacctttccaaatgcagctttcatactcaactttgtaggatcaccagcatacacaccagaacaaaagggttcgatcaagcgttcgaagacctca

SEQ ID NO: 114 - DNA, 200 bp, Amaranthus hybridus
cctcgagacccccgccttcctaaacctaagggccagactgttggatcctttaggaaagggctcattatgttacctaccgccattgctgctaggcttggcagtaaagtcaaactatcgtggacactttctaatattgataagtcgctcaatggtgaatacattctcacttatcaaacacccgatggaccggtttctgttag

SEQ ID NO: 115 - DNA, 200 bp, Amaranthus hybridus
ctaacagaaaccggtccatcgggtgtttgataagtgagaatgtattcaccattgagcgacttatcaatattagaaagtgtccacgatagtttgactttactgccaagcctagcagcaatggcggtaggtaacataatgagccctttcctaaaggatccaacagtctggcccttaggtttaggaaggcgggggtctcgagg

SEQ ID NO: 116 - DNA, 200 bp, Amaranthus hybridus
cacccgatggaccggtttctgttaggaccaaagcggttgtcatgactgtcccttcatacattgcaagtagcctgcttcgtccgctctcagatgttgctgcagattctctttctaagttttactatccaccagtcgcagcagtgtccctttcttatcccaaagaagcaattagaccagaatgcttgatcgatggagaacta

SEQ ID NO: 117 - DNA, 200 bp, Amaranthus hybridus
tagttctccatcgatcaagcattctggtctaattgcttctttgggataagaaagggacactgctgcgactggtggatagtaaaacttagaaagagaatctgcagcaacatctgagagcggacgaagcaggctacttgcaatgtatgaagggacagtcatgacaaccgctttggtcctaacagaaaccggtccatcgggtg

SEQ ID NO: 118 - DNA, 200 bp, Amaranthus hybridus
agaatgcttgatcgatggagaactaaaaggattcgggcaattgcatccccgcagccagggtgtggaaaccttgggaacaatttatagttcatctcttttcccttggttcgagcaccacccggtaggaccttgatcttgagctacattggaggtgctacaaatgttggaatattacaaaagagtgaagatgaacttgcgga

SEQ ID NO: 119 - DNA, 200 bp, Amaranthus hybridus
tccgcaagttcatcttcactcttttgtaatattccaacatttgtagcacctccaatgtagctcaagatcaaggtcctaccgggtggtgctcgaaccaagggaaaagagatgaactataaattgttcccaaggtttccacaccctggctgcggggatgcaattgcccgaatccttttagttctccatcgatcaagcattct

SEQ ID NO: 120 - DNA, 200 bp, Amaranthus lividus
tagattgttgagagggaatgggcaattaagtggaatcccatttccttaaactcagctggtgtatgtaatggtgtctttccaccttcaatcatgtttgcaattctcaaacctttaacatctctaacaacctcttttagctcttctatgttggctggtgcctcaacaaatgtggcatcagcccctgcctctctgtaaagatt

SEQ ID NO: 121 - DNA, 200 bp, Amaranthus lividus
aatctttacagagaggcaggggctgatgccacatttgttgaggcaccagccaacatagaagagctaaaagaggttgttagagatgttaaaggtttgagaattgcaaacatgattgaaggtggaaagacaccattacatacaccagctgagtttaaggaaatgggattccacttaattgcccattccctctcaacaatcta

SEQ ID NO: 122 - DNA, 200 bp, Amaranthus lividus
cagcccctgcctctctgtaaagattagcacgtctaatagcttcttgaagaccgtgaggtgcacgagcatcagtccttgcaaccaagaagaaatcagattcaccaatggcttcccttgctgcagcgatcttaagggcgtgctcctctgcaggaacaactgccttaccacgcatgtgaccacacttctttggccatacttga

SEQ ID NO: 123 - DNA, 200 bp, Amaranthus lividus
tcaagtatggccaaagaagtgtggtcacatgcgtggtaaggcagttgttcctgcagaggagcacgcccttaagatcgctgcagcaagggaagccattggtgaatctgatttcttcttggttgcaaggactgatgctcgtgcacctcacggtcttcaagaagctattagacgtgctaatctttacagagaggcaggggctg

SEQ ID NO: 124 - DNA, 200 bp, Amaranthus lividus
accacacttctttggccatacttgatcctcaaggaaaacacccttggcaccagctgcgatcaagtctttgatgaacctttgaacattaagaggaccaccaccaccggtgtctccgtcaacaataacacacaaactaggagcagctgccgtaattctgcgaacaacatctaccacttctgcagttgtaagcaagccaaagt

SEQ ID NO: 125 - DNA, 200 bp, Amaranthus lividus
actttggcttgcttacaactgcagaagtggtagatgttgttcgcagaattacggcagctgctcctagtttgtgtgttattgttgacggagacaccggtggtggtggtcctcttaatgttcaaaggttcatcaaagacttgatcgcagctggtgccaagggtgttttccttgaggatcaagtatggccaaagaagtgtggt

SEQ ID NO: 126 - DNA, 200 bp, Amaranthus lividus
tctgcagttgtaagcaagccaaagtcgggcaagccaagaagagcagcggaaacaccaaaaccggagacaaagcaagctttgaagccggttttagcgcaaatggcggcggagaaagcgtcttggattccgggcattaaaattggtccctcctcggcgatcagacggtgcattgtggtctttccgactgcctcaagagaacc

SEQ ID NO: 127 - DNA, 200 bp, Amaranthus lividus
ggttctcttgaggcagtcggaaagaccacaatgcaccgtctgatcgccgaggagggaccaattttaatgcccggaatccaagacgctttctccgccgccatttgcgctaaaaccggcttcaaagcttgctttgtctccggttttggtgtttccgctgctcttcttggcttgcccgactttggcttgcttacaactgcaga

SEQ ID NO: 128 - DNA, 200 bp, Amaranthus lividus
tctttccgactgcctcaagagaacccatttttgtttctaataatacaatttaggaattaaggaaggaggtgatgatgagttgatagaactacttagtgtgtaattgttggagctggtatcagtggactttgcattgcgcaggctctttctaccaaacacattcaatccaatctcaatttcattgtcactgaagctaaaca

SEQ ID NO: 129 - DNA, 200 bp, Amaranthus lividus
tgtttagcttcagtgacaatgaaattgagattggattgaatgtgtttggtagaaagagcctgcgcaatgcaaagtccactgataccagctccaacaattacacactaagtagttctatcaactcatcatcacctccttccttaattcctaaattgtattattagaaacaaaaatgggttctcttgaggcagtcggaaaga

SEQ ID NO: 130 - DNA, 200 bp, Amaranthus lividus
atttcattgtcactgaagctaaacatcgtgttggaggtaatattactaccatggagtccgatggctatatctgggaagagggtcctaatagtttccaaccctctgatcctgtgcttactatggcggttgacagtggattgaaagacgatttggttttgggagatcctgatgcccctcgtttcgtgctctggaatggtaaa

SEQ ID NO: 131 - DNA, 200 bp, Amaranthus lividus
tttaccattccagagcacgaaacgaggggcatcaggatctcccaaaaccaaatcgtctttcaatccactgtcaaccgccatagtaagcacaggatcagagggttggaaactattaggaccctcttcccagatatagccatcggactccatggtagtaatattacctccaacacgatgtttagcttcagtgacaatgaaat

SEQ ID NO: 132 - DNA, 200 bp, Amaranthus lividus
tcgtttcgtgctctggaatggtaaattaaggcctgttccttctaaacctacggaccttcccttttttgatctcatgagctttcctggtaagattagggctggtcttggtgcacttggtcttcgtcctcctcctcctcctccttcttatgaggaatctgttgaagaatttgtgcgccgtaatctcggcgatgaggtcttcg

SEQ ID NO: 133 - DNA, 200 bp, Amaranthus lividus
cgaagacctcatcgccgagattacggcgcacaaattcttcaacagattcctcataagaaggaggaggaggaggaggacgaagaccaagtgcaccaagaccagccctaatcttaccaggaaagctcatgagatcaaaaaagggaaggtccgtaggtttagaaggaacaggccttaatttaccattccagagcacgaaacga

SEQ ID NO: 134 - DNA, 200 bp, Amaranthus lividus
cgtaatctcggcgatgaggtcttcgaacgcttaatcgaacccttttgttctggtgtgtatgctggtgatcctacaaagttgagtatgaaagctgcatttggaaaggtctggaccttagagcaaaagggtggtagtatcatcgccggtacactcaaatctattcaggaaaggaagaataatcctccaccccctcgagaccc

SEQ ID NO: 135 - DNA, 200 bp, Amaranthus lividus
gggtctcgagggggtggaggattattcttcctttcctgaatagatttgagtgtaccggcgatgatactaccacccttttgctctaaggtccagacctttccaaatgcagctttcatactcaactttgtaggatcaccagcatacacaccagaacaaaagggttcgattaagcgttcgaagacctcatcgccgagattacg

SEQ ID NO: 136 - DNA, 200 bp, Amaranthus lividus
ataatcctccaccccctcgagacccccgccttcctaaacctaagggccagactgttggatcctttaggaaagggctcattatgttacctaccgccattgctgctaggcttggcagtaaagtcaaactatcgtggacactttctaatattgataagtcgctcaatggtgaatacaatctcacttatcaaacacccgatgga

SEQ ID NO: 137 - DNA, 200 bp, Amaranthus lividus
tccatcgggtgtttgataagtgagattgtattcaccattgagcgacttatcaatattagaaagtgtccacgatagtttgactttactgccaagcctagcagcaatggcggtaggtaacataatgagccctttcctaaaggatccaacagtctggcccttaggtttaggaaggcgggggtctcgagggggtggaggattat

SEQ ID NO: 138 - DNA, 200 bp, Amaranthus lividus
tctcacttatcaaacacccgatggaccggtttctgttaggaccaaagcggttgtcatgactgtaccttcatacattgcaagtagcctgcttcgtccactctcagatgttgctgcagattctctttctaagttttactatccaccagtcgcagcagtgtccctttcttatcccaaggaagcaattagaccagaatgcttga

SEQ ID NO: 139 - DNA, 200 bp, Amaranthus lividus
tcaagcattctggtctaattgcttccttgggataagaaagggacactgctgcgactggtggatagtaaaacttagaaagagaatctgcagcaacatctgagagtggacgaagcaggctacttgcaatgtatgaaggtacagtcatgacaaccgctttggtcctaacagaaaccggtccatcgggtgtttgataagtgaga

SEQ ID NO: 140 - DNA, 200 bp, Amaranthus lividus
gaagcaattagaccagaatgcttgatcgatggagaactaaaaggattcgggcaattgcatccccgcagccagggtgtggaaaccttgggaacaatttatagttcatctcttttccctggtcgagcaccacccggtaggaccttgatcttgagctacattggaggtgctacaaatgttggaatattacaaaagagtgaaga

SEQ ID NO: 141 - DNA, 200 bp, Amaranthus lividus
tcttcactcttttgtaatattccaacatttgtagcacctccaatgtagctcaagatcaaggtcctaccgggtggtgctcgaccagggaaaagagatgaactataaattgttcccaaggtttccacaccctggctgcggggatgcaattgcccgaatccttttagttctccatcgatcaagcattctggtctaattgcttc

SEQ ID NO: 142 - DNA, 200 bp, Amaranthus lividus
ttggaatattacaaaagagtgaagatgaacttgcggagacagttgataaggatctcagaaaaattctgataaatccaaatgcgaaaggcagccgtgttctgggagtgagagtatggccaaaggcaatcccccaatttttagttggtcactttgatctgctagatgctgcaaaagctggtttggcaaatgctgggctaaag

SEQ ID NO: 143 - DNA, 200 bp, Amaranthus lividus
ctttagcccagcatttgccaaaccagcttttgcagcatctagcagatcaaagtgaccaactaaaaattgggggattgcctttggccatactctcactcccagaacacggctgcctttcgcatttggatttatcagaatttttctgagatccttatcaactgtctccgcaagttcatcttcactcttttgtaatattccaa

SEQ ID NO: 144 - DNA, 200 bp, Amaranthus lividus
tggtttggcaaatgctgggctaaaggggttgtttcttggtggtaattatgtatcaggtgttgccttggggaggtgtatagagggtgcttatgactctgcatctcaggtagtggatttcctctcacagtacaaagacaagtagtcaatagggctccaccttcctggttaactaactttttgtagctgttgtaatttgtatc

SEQ ID NO: 145 - DNA, 200 bp, Amaranthus lividus
gatacaaattacaacagctacaaaaagttagttaaccaggaaggtggagccctattgactacttgtctttgtactgtgagaggaaatccactacctgagatgcagagtcataagcaccctctatacacctccccaaggcaacacctgatacataattaccaccaagaaacaacccctttagcccagcatttgccaaacca

SEQ ID NO: 146 - DNA, 200 bp, Amaranthus palmeri
aatccttgatttgaagataggataaccagagagagtgcaagagagatgagtgccatggcgttatcgagcagcattctacaatgtccgccgcactccgacatctctttccgcttttctgcttatacaccaacccgctcccccatcttcttcggaagacctcgaaaattatcatatatccattgttccacaagctcaagctc

SEQ ID NO: 147 - DNA, 200 bp, Amaranthus palmeri
gagcttgagcttgtggaacaatggatatatgataattttcgaggtcttccgaagaagatgggggagcgggttggtgtataagcagaaaagcggaaagagatgtcggagtgcggcggacattgtagaatgctgctcgataacgccatggcactcatctctcttgcactctctctggttatcctatcttcaaatcaaggatt

SEQ ID NO: 148 - DNA, 200 bp, Amaranthus palmeri
tccattgttccacaagctcaagctcaactgccaattaccagaacacgattacgacccaaggagaaggagataaagtattggattgtgtaattgttggagctggtatcagtggactttgcattgctcaggctctttctaccaaacacattcaatccaatctcaatttcattgtcactgaagctaaaaatcgtgttggaggt

SEQ ID NO: 149 - DNA, 200 bp, Amaranthus palmeri
acctccaacacgatttttagcttcagtgacaatgaaattgagattggattgaatgtgtttggtagaaagagcctgagcaatgcaaagtccactgataccagctccaacaattacacaatccaatactttatctccttctccttgggtcgtaatcgtgttctggtaattggcagttgagcttgagcttgtggaacaatgga

SEQ ID NO: 150 - DNA, 200 bp, Amaranthus palmeri
tgaagctaaaaatcgtgttggaggtaatatcactaccatggagtccgatggctatatctgggaagagggtcctaatagtttccaaccctccgatcctgtgcttactatggcggttgacagtggattgaaagatgatttggtcttgggagatcctaatgctcctcgttttgtgctctggaatggtaaattaaggcctgttc

SEQ ID NO: 151 - DNA, 200 bp, Amaranthus palmeri
gaacaggccttaatttaccattccagagcacaaaacgaggagcattaggatctcccaagaccaaatcatctttcaatccactgtcaaccgccatagtaagcacaggatcggagggttggaaactattaggaccctcttcccagatatagccatcggactccatggtagtgatattacctccaacacgatttttagcttca

SEQ ID NO: 152 - DNA, 200 bp, Amaranthus palmeri
tggaatggtaaattaaggcctgttccttccaaacctacggaccttcccttttttgatctcatgagctttcctggtaagattagggctggtcttggtgcacttggtcttcgtccttctcctcctcctccttcttatgaggaatctgttgaagaatttgtgcgccgtaatctcggcgatgaggtcttcgaacgcttgatcga

SEQ ID NO: 153 - DNA, 200 bp, Amaranthus palmeri
tcgatcaagcgttcgaagacctcatcgccgagattacggcgcacaaattcttcaacagattcctcataagaaggaggaggaggagaaggacgaagaccaagtgcaccaagaccagccctaatcttaccaggaaagctcatgagatcaaaaaagggaaggtccgtaggtttggaaggaacaggccttaatttaccattcca

SEQ ID NO: 154 - DNA, 200 bp, Amaranthus palmeri
atgaggtcttcgaacgcttgatcgaacccttttgttctggtgtgtatgctggtgatccttcaaagttgagtatgaaagctgcatttggaaaggtctggaccttagagcaaaagggtggtagtatcatcgccggtacactcaaaactattcaggaaaggaagaataatcctccaccgcctcgagacccccgccttcctaaa

SEQ ID NO: 155 - DNA, 200 bp, Amaranthus palmeri
tttaggaaggcgggggtctcgaggcggtggaggattattcttcctttcctgaatagttttgagtgtaccggcgatgatactaccacccttttgctctaaggtccagacctttccaaatgcagctttcatactcaactttgaaggatcaccagcatacacaccagaacaaaagggttcgatcaagcgttcgaagacctcat

SEQ ID NO: 156 - DNA, 200 bp, Amaranthus palmeri
gcctcgagacccccgccttcctaaacctaagggccagactgttggatcctttaggaaagggctcattatgttacctaccgccattgctgctaggcttggcagtaaagtcaaactatcgtggacactttctaatattgataagtcgctcaatggtgaatacaatctcacttatcaaacacccgatggaccggtttctgtta

SEQ ID NO: 157 - DNA, 200 bp, Amaranthus palmeri
taacagaaaccggtccatcgggtgtttgataagtgagattgtattcaccattgagcgacttatcaatattagaaagtgtccacgatagtttgactttactgccaagcctagcagcaatggcggtaggtaacataatgagccctttcctaaaggatccaacagtctggcccttaggtttaggaaggcgggggtctcgaggc

SEQ ID NO: 158 - DNA, 200 bp, Amaranthus palmeri
acacccgatggaccggtttctgttaggaccaaagcggttgtcatgactgtcccttcatacattgcaagtagcctgcttcgtccgctctcatgatgttgctgcagattctctttctaaattttactatccaccagtcgcagcagtgtccctttcttatcccaaagaagcaattagaccagaatgcttgatcgatggagaac

SEQ ID NO: 159 - DNA, 200 bp, Amaranthus palmeri
gttctccatcgatcaagcattctggtctaattgcttctttgggataagaaagggacactgctgcgactggtggatagtaaaatttagaaagagaatctgcagcaacatcatgagagcggacgaagcaggctacttgcaatgtatgaagggacagtcatgacaaccgctttggtcctaacagaaaccggtccatcgggtgt

SEQ ID NO: 160 - DNA, 200 bp, Amaranthus palmeri
ccagaatgcttgatcgatggagaactaaaaggattcgggcaattgcatcccgcagccagggtgtggaaaccttgggaacaatttatagttcatctcttttccctggtcgagcaccacctggtaggaccttgatcttgagctacattggaggtgctacaaatgttggcatattacaaaagagtgaagatgaacttgcggag

SEQ ID NO: 161 - DNA, 200 bp, Amaranthus palmeri
ctccgcaagttcatcttcactcttttgtaatatgccaacatttgtagcacctccaatgtagctcaagatcaaggtcctaccaggtggtgctcgaccagggaaaagagatgaactataaattgttcccaaggtttccacaccctggctgcgggatgcaattgcccgaatccttttagttctccatcgatcaagcattctgg

SEQ ID NO: 162 - DNA, 200 bp, Amaranthus palmeri
aaagagtgaagatgaacttgcggagacagttgataaggatctcagaaaaattctgataaatccaaatgcgaaaggcagccgtgttctgggagtgagagtatggccaaaggcaatcccccaatttttagtaggtcattttgatctgctagatgctgcaaaagcgggtttggcaaatgctggactaaaggggttgtttcttg

SEQ ID NO: 163 - DNA, 200 bp, Amaranthus palmeri
caagaaacaacccctttagtccagcatttgccaaacccgcttttgcagcatctagcagatcaaaatgacctactaaaaattgggggattgcctttggccatactctcactcccagaacacggctgcctttcgcatttggatttatcagaatttttctgagatccttatcaactgtctccgcaagttcatcttcactcttt

SEQ ID NO: 164 - DNA, 200 bp, Amaranthus palmeri
gctggactaaaggggttgtttcttggtggtaattatgtatcaggtgttgccttggggaggtgtatagagggtgcttatgactctgcatctcaggttgtggatttcctctcacagtacaaagacaagtagtcatcctgattaactaactttttgtagctgttgtaatttgtatcatgtaatattattatttattcagatgt

SEQ ID NO: 165 - DNA, 200 bp, Amaranthus palmeri
acatctgaataaataataatattacatgatacaaattacaacagctacaaaaagttagttaatcaggatgactacttgtctttgtactgtgagaggaaatccacaacctgagatgcagagtcataagcaccctctatacacctccccaaggcaacacctgatacataattaccaccaagaaacaacccctttagtccagc

SEQ ID NO: 166 - DNA, 200 bp, Amaranthus palmeri
acataaaaccgctacatggaggcacggttttgtgtcaaatgtaaaccactactccatgtagcggtttggtgcacatacttttcaactctcagtgtgttgctgacgtggacggtagtgcgggaattattttacaaagtaacgtaaagtgggaattttttttaaataagctgcattttgggcaaagactctacttttacttt

SEQ ID NO: 167 - DNA, 200 bp, Amaranthus palmeri
aaagtaaaagtagagtctttgcccaaaatgcagcttatttaaaaaaaattcccactttacgttactttgtaaaataattcccgcactaccgtccacgtcagcaacacactgagagttgaaaagtatgtgcaccaaaccgctacatggagtagtggtttacatttgacacaaaaccgtgcctccatgtagcggttttatgt

SEQ ID NO: 168 - DNA, 200 bp, Amaranthus palmeri
tgggcaaagactctacttttacttttaattttatttttaattttaataaagaaggaagaaaaaaaacaaatgtatttatggataaagaatccttgatttgaagataggataaccagagagagggcaagagagatgagtgccatggcgttatcgagcagcattctacaatgtctgccgcactccgacatctctttccgctt

SEQ ID NO: 169 - DNA, 200 bp, Amaranthus palmeri
aagcggaaagagatgtcggagtgcggcagacattgtagaatgctgctcgataacgccatggcactcatctctcttgccctctctctggttatcctatcttcaaatcaaggattctttatccataaatacatttgttttttttcttccttctttattaaaattaaaaataaaattaaaagtaaaagtagagtctttgccca

SEQ ID NO: 170 - DNA, 200 bp, Amaranthus palmeri
cgcactccgacatctctttccgcttttctgcttatacaccaacccgctcccccatcttcttcggaagaccacgaaaattatcatatatccattgttccacaagctcaagctcaactgccaattaccagaacacgattacgacccaaggagaaggagataaagtattggattgtgtaattgttggagctggtatcagtgga

SEQ ID NO: 171 - DNA, 200 bp, Amaranthus palmeri
tccactgataccagctccaacaattacacaatccaatactttatctccttctccttgggtcgtaatcgtgttctggtaattggcagttgagcttgagcttgtggaacaatggatatatgataattttcgtggtcttccgaagaagatgggggagcgggttggtgtataagcagaaaagcggaaagagatgtcggagtgcg

SEQ ID NO: 172 - DNA, 200 bp, Amaranthus palmeri
aattgttggagctggtatcagtggactttgcattgctcaggctctttctactaaacacattcaatccaatctcaatttcattgtcactgaagctaaaaatcgtgttggaggtaatatcactaccatggagtccgatggctatatctgggaagagggtcctaatagtttccaaccctccgatcctgtgcttactatggcgg

SEQ ID NO: 173 - DNA, 200 bp, Amaranthus palmeri
ccgccatagtaagcacaggatcggagggttggaaactattaggaccctcttcccagatatagccatcggactccatggtagtgatattacctccaacacgatttttagcttcagtgacaatgaaattgagattggattgaatgtgtttagtagaaagagcctgagcaatgcaaagtccactgataccagctccaacaatt

SEQ ID NO: 174 - DNA, 200 bp, Amaranthus palmeri
tccgatcctgtgcttactatggcggtaaactcattcttctctctttctccaatttttgatcattctattcaattttccccttattgagtcaaaatcaaattccaggttgacagtggattgaaagatgatttggtcttgggagatcctaatgctcctcgttttgtgctctggaatggtaaattaaggcctgttccttccaa

SEQ ID NO: 175 - DNA, 200 bp, Amaranthus palmeri
ttggaaggaacaggccttaatttaccattccagagcacaaaacgaggagcattaggatctcccaagaccaaatcatctttcaatccactgtcaacctggaatttgattttgactcaataaggggaaaattgaatagaatgatcaaaaattggagaaagagagaagaatgagtttaccgccatagtaagcacaggatcgga

SEQ ID NO: 176 - DNA, 200 bp, Amaranthus palmeri
gtaaattaaggcctgttccttccaaacctacggaccttcccttttttgatctcatgagctttcctggtaagattagggctggtcttggtgcacttggtcttcgtccttctccccctcctccttcttatgaggaatctgttgaagagtttgtgcgccgtaatctcggcgatgaggtcttcgaacgcttgatcgaacccttt

SEQ ID NO: 177 - DNA, 200 bp, Amaranthus palmeri
aaagggttcgatcaagcgttcgaagacctcatcgccgagattacggcgcacaaactcttcaacagattcctcataagaaggaggagggggagaaggacgaagaccaagtgcaccaagaccagccctaatcttaccaggaaagctcatgagatcaaaaaagggaaggtccgtaggtttggaaggaacaggccttaatttac

SEQ ID NO: 178 - DNA, 200 bp, Amaranthus palmeri
cttcgaacgcttgatcgaacccttttgttctggtacctaccctgtttaatttttcagttttcccccttttttctctactactcctactttattgattcttatctatgagtgttctatgggaattgacattaattgttcaggtgtgtatgctggtgatccttcaaagttgagtatgaaagctgcatttggaaaggtctgga

SEQ ID NO: 179 - DNA, 200 bp, Amaranthus palmeri
tccagacctttccaaatgcagctttcatactcaactttgaaggatcaccagcatacacacctgaacaattaatgtcaattcccatagaacactcatagataagaatcaataaagtaggagtagtagagaaaaaagggggaaaactgaaaaattaaacagggtaggtaccagaacaaaagggttcgatcaagcgttcgaag

SEQ ID NO: 180 - DNA, 200 bp, Amaranthus palmeri
aaagctgcatttggaaaggtctggaccttagagcaaaagggtggtagtatcatcgccggtacactcaaaactattcaggaaaggaagaataatcctccaccgcctcgagacccgtccgtaatcaccattactcattgctttccttcaccttgtatcttaccttaatatacatgtatttaattgataatgtcacattgcct

SEQ ID NO: 181 - DNA, 200 bp, Amaranthus palmeri
aggcaatgtgacattatcaattaaatacatgtatattaaggtaagatacaaggtgaaggaaagcaatgagtaatggtgattacggacgggtctcgaggcggtggaggattattcttcctttcctgaatagttttgagtgtaccggcgatgatactaccacccttttgctctaaggtccagacctttccaaatgcagcttt

SEQ ID NO: 182 - DNA, 200 bp, Amaranthus palmeri
tttaattgataatgtcacattgcctcatttgcagccgccttcctaaacctaagggccagactgttggatcctttaggaaagggctcattatgttacctaccgccattgctgctaggtatcttttgactctcaaatcttaaatatttctcatcttttccttctgctaatactagtatgtttaccatctttttattttttta

SEQ ID NO: 183 - DNA, 200 bp, Amaranthus palmeri
taaaaaaataaaaagatggtaaacatactagtattagcagaaggaaaagatgagaaatatttaagatttgagagtcaaaagatacctagcagcaatggcggtaggtaacataatgagccctttcctaaaggatccaacagtctggcccttaggtttaggaaggcggctgcaaatgaggcaatgtgacattatcaattaaa

SEQ ID NO: 184 - DNA, 200 bp, Amaranthus palmeri
tgtttaccatctttttatttttttaggcttggcagtaaagtcaaactatcgtggacactttctaatattgataagtcgctcaatggtgaatacaatctcacttatcaaacacccgatggaccggtttctgttaggaccaaagcggttgtcatgactgtcccttcatacattgcaagtagcctgcttcgtccgctctcagt

SEQ ID NO: 185 - DNA, 200 bp, Amaranthus palmeri
actgagagcggacgaagcaggctacttgcaatgtatgaagggacagtcatgacaaccgctttggtcctaacagaaaccggtccatcgggtgtttgataagtgagattgtattcaccattgagcgacttatcaatattagaaagtgtccacgatagtttgactttactgccaagcctaaaaaaataaaaagatggtaaaca

SEQ ID NO: 186 - DNA, 200 bp, Amaranthus palmeri
gtagcctgcttcgtccgctctcagtgagtatcattctttccttcatttcttttcgtttattgctgtccaatgtcttgttaaacaccagtttggccttgtgctcgtgaattatggctacaatgttaactgattctgtgattcaggcactgtgggagatgcctaagtttctaaaacctctgcgcataatgtttgtttggatg

SEQ ID NO: 187 - DNA, 200 bp, Amaranthus palmeri
catccaaacaaacattatgcgcagaggttttagaaacttaggcatctcccacagtgcctgaatcacagaatcagttaacattgtagccataattcacgagcacaaggccaaactggtgtttaacaagacattggacagcaataaacgaaaagaaatgaaggaaagaatgatactcactgagagcggacgaagcaggctac

SEQ ID NO: 188 - DNA, 200 bp, Amaranthus palmeri
tctgcgcataatgtttgtttggatgttaggaattgcattgaaaaattgcttttgtgatgttgatgttaataccaattacaagtgtgttcttcaacttctgcaataccttgttcgagtgagcttgagggggtttagattagtgtccaatgtgaaactagcaaatgaactccaagcgctgggataggtccttgggatggagc

SEQ ID NO: 189 - DNA, 200 bp, Amaranthus palmeri
gctccatcccaaggacctatcccagcgcttggagttcatttgctagtttcacattggacactaatctaaaccccctcaagctcactcgaacaaggtattgcagaagttgaagaacacacttgtaattggtattaacatcaacatcacaaaagcaatttttcaatgcaattcctaacatccaaacaaacattatgcgcaga

SEQ ID NO: 190 - DNA, 200 bp, Amaranthus palmeri
ctgggataggtccttgggatggagcccctgatacccaagacagtattcaaaccctctaagtagagtgagagatcaaggaaagaaactgggtggttcctcaaatcgtaaaaaatgaatacagtgtcatgattgctaatcttatcacaaatcgtaaaaaatgaattatggtcgattttggactatttttgggtcattttgag

SEQ ID NO: 191 - DNA, 200 bp, Amaranthus palmeri
ctcaaaatgacccaaaaatagtccaaaatcgaccataattcattttttacgatttgtgataagattagcaatcatgacactgtattcattttttacgatttgaggaaccacccagtttctttccttgatctctcactctacttagagggtttgaatactgtcttgggtatcaggggctccatcccaaggacctatcccag

SEQ ID NO: 192 - DNA, 200 bp, Amaranthus palmeri
tggactatttttgggtcattttgagtgaatctcaaacttaaaaagcgagtcttctagcagttcttgttacagcggggcatacataggtaggaatttggttttttactatttgagccttttgactgttgtggccggtaatatggaatagtctagcacttctgcgtgtgtacaactagtatttattgtaattatgtgatcgc

SEQ ID NO: 193 - DNA, 200 bp, Amaranthus palmeri
gcgatcacataattacaataaatactagttgtacacacgcagaagtgctagactattccatattaccggccacaacagtcaaaaggctcaaatagtaaaaaaccaaattcctacctatgtatgccccgctgtaacaagaactgctagaagactcgctttttaagtttgagattcactcaaaatgacccaaaaatagtcca

SEQ ID NO: 194 - DNA, 200 bp, Amaranthus palmeri
gtatttattgtaattatgtgatcgcacttaactctcagataaaaccttaagcactaacattttgttttggttgaaggaatcaggaggaaagaaaattgagggatttgttggtatatagattcctttgtttggataacaaaattggagtggagagatttggaaggaagaattttatagggattagttcccattacacttat

SEQ ID NO: 195 - DNA, 200 bp, Amaranthus palmeri
ataagtgtaatgggaactaatccctataaaattcttccttccaaatctctccactccaattttgttatccaaacaaaggaatctatataccaacaaatccctcaattttctttcctcctgattccttcaaccaaaacaaaatgttagtgcttaaggttttatctgagagttaagtgcgatcacataattacaataaatac

SEQ ID NO: 196 - DNA, 200 bp, Amaranthus palmeri
attatatgtcatgtaatataaatagaaaattattatttaaataattaatttcaaactttgtatcaataaaacacttaattttttgattattagagtgtatatgaaaaatatgtaaaaaaaagtcgtacataagaaaatttcattgtaattaagactaaatttgatgaatcgattcgtaaaattgctctatgatcctacaa

SEQ ID NO: 197 - DNA, 200 bp, Amaranthus palmeri
ttgtaggatcatagagcaattttacgaatcgattcatcaaatttagtcttaattacaatgaaattttcttatgtacgacttttttttacatatttttcatatacactctaataatcaaaaaattaagtgttttattgatacaaagtttgaaattaattatttaaataataattttctatttatattacatgacatataat

SEQ ID NO: 198 - DNA, 200 bp, Amaranthus palmeri
gtaaaattgctctatgatcctacaacccacttatttatttcaattaggactgtaattaagtttaaatttacattagttgaattattgccttttatgagagatgtggtatcgtatgctatctaaaggctaaaactattaagtcgatttaaaatctatccaaattttatacttaattgaactaggttgaattgaacggagaa

SEQ ID NO: 199 - DNA, 200 bp, Amaranthus palmeri
ttctccgttcaattcaacctagttcaattaagtataaaatttggatagattttaaatcgacttaatagttttagcctttagatagcatacgataccacatctctcataaaaggcaataattcaactaatgtaaatttaaacttaattacagtcctaattgaaataaataagtgggttgtaggatcatagagcaattttac

SEQ ID NO: 200 - DNA, 200 bp, Amaranthus palmeri
gaactaggttgaattgaacggagaattaatcaaaaatgtaccacccttgaatcactatcaatattaaagcaaaccaactttaatccataaatgaaaatcaacttagtcaaatcacatatgaacccgtcaatcatgccaaaaactctgagagtgtttgatattataacttattagaaaattttaacttatttgacgcaaat

SEQ ID NO: 201 - DNA, 200 bp, Amaranthus palmeri
atttgcgtcaaataagttaaaattttctaataagttataatatcaaacactctcagagtttttggcatgattgacgggttcatatgtgatttgactaagttgattttcatttatggattaaagttggtttgctttaatattgatagtgattcaagggtggtacatttttgattaattctccgttcaattcaacctagttc

SEQ ID NO: 202 - DNA, 200 bp, Amaranthus palmeri
aaattttaacttatttgacgcaaatagacggataagtgttctaaccatctagctctagtgtttcgcttaataaaaataaataatttttaaacatgctcctataaatcaactgatcaaaccggtttataaaatcaccaactaaatcgacccattcaaatcaaataccaactcggtcgtttgccaaacacttcgctatgact

SEQ ID NO: 203 - DNA, 200 bp, Amaranthus palmeri
agtcatagcgaagtgtttggcaaacgaccgagttggtatttgatttgaatgggtcgatttagttggtgattttataaaccggtttgatcagttgatttataggagcatgtttaaaaattatttatttttattaagcgaaacactagagctagatggttagaacacttatccgtctatttgcgtcaaataagttaaaattt

SEQ ID NO: 204 - DNA, 200 bp, Amaranthus palmeri
gtttgccaaacacttcgctatgacttcaatcaaacaaaatgcaacttgtttgctgctaccgacttaccgccttacccagtacgcggaaaagataatcaatgagaatcaaattcaaatcttgacaagataatatgattatcccattattatcaatttaattatgattaaccttttttaagataacctaataattcattgat

SEQ ID NO: 205 - DNA, 200 bp, Amaranthus palmeri
atcaatgaattattaggttatcttaaaaaaggttaatcataattaaattgataataatgggataatcatattatcttgtcaagatttgaatttgattctcattgattatcttttccgcgtactgggtaaggcggtaagtcggtagcagcaaacaagttgcattttgtttgattgaagtcatagcgaagtgtttggcaaac

SEQ ID NO: 206 - DNA, 200 bp, Amaranthus palmeri
taagataacctaataattcattgataagaatgattagcttgtttaatcaacttcaatttacaatttctaccttggaaaattcaaaccaaaaagtgtaaaagaattgatttggcagattgcgacaattggattgagaaattgacaaatttaaactgatcttatggtaattcaatccataacccacctttcaccaaaacttg

SEQ ID NO: 207 - DNA, 200 bp, Amaranthus palmeri
caagttttggtgaaaggtgggttatggattgaattaccataagatcagtttaaatttgtcaatttctcaatccaattgtcgcaatctgccaaatcaattcttttacactttttggtttgaattttccaaggtagaaattgtaaattgaagttgattaaacaagctaatcattcttatcaatgaattattaggttatctta

SEQ ID NO: 208 - DNA, 200 bp, Amaranthus palmeri
ataacccacctttcaccaaaacttgcattgccatcgccattgtcaatttccgccaagaactacccagtagctgtaatgggcaacatttctgagcgggaagaacccagtaagtcaacctttcttcatatatcttaagcaatcccttttgaactacactttcttttgatgattttacattctgaattgtttttattggggat

SEQ ID NO: 209 - DNA, 200 bp, Amaranthus palmeri
atccccaataaaaacaattcagaatgtaaaatcatcaaaagaaagtgtagttcaaaagggattgcttaagatatatgaagaaaggttgacttactgggttcttcccgctcagaaatgttgcccattacagctactgggtagttcttggcggaaattgacaatggcgatggcaatgcaagttttggtgaaaggtgggttat

SEQ ID NO: 210 - DNA, 200 bp, Amaranthus palmeri
attctgaattgtttttattggggattttcagcttctgcgaaaagggttgctgttgttggtgctggagttaggtaaattttatgttacttttccagaaagattgtgaaattttgctttgattgttctgaattttgatgggtttttgcataatgatttgtatttgggatgggcaaatttttcagaagatcatactacttttt

SEQ ID NO: 211 - DNA, 200 bp, Amaranthus palmeri
aaaaagtagtatgatcttctgaaaaatttgcccatcccaaatacaaatcattatgcaaaaacccatcaaaattcagaacaatcaaagcaaaatttcacaatctttctggaaaagtaacataaaatttacctaactccagcaccaacaacagcaacccttttcgcagaagctgaaaatccccaataaaaacaattcagaat

SEQ ID NO: 212 - DNA, 200 bp, Amaranthus palmeri
ttttcagaagatcatactactttttaacttgtgttttctgtagaattttattgattttctaaactgtttttgtgggattgttctagtggacttgctgctgcatataagctaaaatcccatggtttgagtgtgacattgtttgaagctgattctagagctggaggcaagcttaaaactgttaaaaaagatggttttatttg

SEQ ID NO: 213 - DNA, 200 bp, Amaranthus palmeri
caaataaaaccatcttttttaacagttttaagcttgcctccagctctagaatcagcttcaaacaatgtcacactcaaaccatgggattttagcttatatgcagcagcaagtccactagaacaatcccacaaaaacagtttagaaaatcaataaaattctacagaaaacacaagttaaaaagtagtatgatcttctgaaaa

SEQ ID NO: 214 - DNA, 200 bp, Amaranthus palmeri
ctgttaaaaaagatggttttatttgggatgagggggcaaatactatggtaatgtttatcaacaatgctggttttctgatatagaaccaattacttatttattaactggatttttggtcaaacctgtggttggcatgtcactttatgctatgattgtagacagaaagtgaggcagaggtgtcgagtttgatcgatgatctt

SEQ ID NO: 215 - DNA, 200 bp, Amaranthus palmeri
aagatcatcgatcaaactcgacacctctgcctcactttctgtctacaatcatagcataaagtgacatgccaaccacaggtttgaccaaaaatccagttaataaataagtaattggttctatatcagaaaaccagcattgttgataaacattaccatagtatttgccccctcatcccaaataaaaccatcttttttaacag

SEQ ID NO: 216 - DNA, 200 bp, Amaranthus palmeri
ggtgtcgagtttgatcgatgatcttgggcttcgtgagaagcaacagttggtaagttttccgtctaagcccattccctttgctctctaggtgcaaaaatacggtaatagtcatgatcgtggtaatgacatggtgatgcggtgacgggagttatgtgatcgctattccaactataggtcgaaaacatgatattttccttgtg

SEQ ID NO: 217 - DNA, 200 bp, Amaranthus palmeri
cacaaggaaaatatcatgttttcgacctatagttggaatagcgatcacataactcccgtcaccgcatcaccatgtcattaccacgatcatgactattaccgtatttttgcacctagagagcaaagggaatgggcttagacggaaaacttaccaactgttgcttctcacgaagcccaagatcatcgatcaaactcgacacc

SEQ ID NO: 218 - DNA, 200 bp, Amaranthus palmeri
tcgaaaacatgatattttccttgtgacgttccgaaatgcggtatttttacacctttacattgcggggaaaaataggtttagtttttttgaatacctttacaaggcggctgatgcgatgaagccttgtttttgcattatgtgctagaagcaaattattatatctttaattaatgtaatgtatcatcagcttaaaacagcct

SEQ ID NO: 219 - DNA, 200 bp, Amaranthus palmeri
aggctgttttaagctgatgatacattacattaattaaagatataataatttgcttctagcacataatgcaaaaacaaggcttcatcgcatcagccgccttgtaaaggtattcaaaaaaactaaacctatttttccccgcaatgtaaaggtgtaaaaataccgcatttcggaacgtcacaaggaaaatatcatgttttcga

SEQ ID NO: 220 - DNA, 200 bp, Amaranthus palmeri
atgtatcatcagcttaaaacagccttattgtacttcttaatctagttttgacttttgaggttgcttttacgagatccttataaattgctttttctgtcacagccaatttcacaaaataaaaggtacatagctagagatggtcttccggtgctagtaagtcctctgcattttcttttgacctctatgaacttctaacactg

SEQ ID NO: 221 - DNA, 200 bp, Amaranthus palmeri
cagtgttagaagttcatagaggtcaaaagaaaatgcagaggacttactagcaccggaagaccatctctagctatgtaccttttattttgtgaaattggctgtgacagaaaaagcaatttataaggatctcgtaaaagcaacctcaaaagtcaaaactagattaagaagtacaataaggctgttttaagctgatgatacat

SEQ ID NO: 222 - DNA, 200 bp, Amaranthus palmeri
tgacctctatgaacttctaacactggatactgagttgtatttgtattcgaggcaaattctatattttccaatctgtttcttattgacagttacttgcaacctttgcagctaccttcaaatcccgctgcactgctcacgagcaatttcctttcagcaaaatcaaaggttatttatgctaaaacatgtttgtttgttttttt

SEQ ID NO: 223 - DNA, 200 bp, Amaranthus palmeri
aaaaaaacaaacaaacatgttttagcataaataacctttgattttgctgaaaggaaattgctcgtgagcagtgcagcgggatttgaaggtagctgcaaaggttgcaagtaactgtcaataagaaacagattggaaaatatagaatttgcctcgaatacaaatacaactcagtatccagtgttagaagttcatagaggtca

SEQ ID NO: 224 - DNA, 200 bp, Amaranthus palmeri
ctaaaacatgtttgtttgtttttttttaacttagcttttggtgtatgcaataatttggtttctaaaactaagtgattgaccgaaaaggagggacaaaggacatagaattgcaaatttttgttcttgacgtatttttacttttagagcatccccttgtgtaaaacttttattttagagctgcaagaatttgttgcatcttt

SEQ ID NO: 225 - DNA, 200 bp, Amaranthus palmeri
aaagatgcaacaaattcttgcagctctaaaataaaagttttacacaaggggatgctctaaaagtaaaaatacgtcaagaacaaaaatttgcaattctatgtcctttgtccctccttttcggtcaatcacttagttttagaaaccaaattattgcatacaccaaaagctaagttaaaaaaaaacaaacaaacatgttttag

SEQ ID NO: 226 - DNA, 200 bp, Amaranthus palmeri
agctgcaagaatttgttgcatcttttgttatgatttaattttgatgcttttagctgcaacagtttgttgataaaaaggccactgcttttttctcagctgcaaattatgttggaaccatttctctggaaaaaacgcaatgctactgagctttctgatgagcatgttcaggaaaggcaagtgcccttgctctatctatactg

SEQ ID NO: 227 - DNA, 200 bp, Amaranthus palmeri
cagtatagatagagcaagggcacttgcctttcctgaacatgctcatcagaaagctcagtagcattgcgttttttccagagaaatggttccaacataatttgcagctgagaaaaaagcagtggcctttttatcaacaaactgttgcagctaaaagcatcaaaattaaatcataacaaaagatgcaacaaattcttgcagct

SEQ ID NO: 228 - DNA, 200 bp, Amaranthus palmeri
aagtgcccttgctctatctatactgatggaaaggattatcgctgaatttaccttctactgaaacatcaataaaatacttcattattagcatcaaaatactccctccatccttctggttttgctggactttccctatgaaggtgttcaaggagtagcttgctacctttcaagatagggtagtggttgccttctcgcaaaat

SEQ ID NO: 229 - DNA, 200 bp, Amaranthus palmeri
attttgcgagaaggcaaccactaccctatcttgaaaggtagcaagctactccttgaacaccttcatagggaaagtccagcaaaaccagaaggatggagggagtattttgatgctaataatgaagtattttattgatgtttcagtagaaggtaaattcagcgataatcctttccatcagtatagatagagcaagggcactt

SEQ ID NO: 230 - DNA, 200 bp, Amaranthus palmeri
ggtagtggttgccttctcgcaaaatttcagtcactcgttttcctctcctaattcaagccatactttttatggttcctccacacaactcttgctaaatttgaaaagtagcaaagaggaagtgagcaaaatcagcaggagtaggactgatgagtaagagcttgatcaagtataaaggatatgtttctatgtagaatatgaat

SEQ ID NO: 231 - DNA, 200 bp, Amaranthus palmeri
attcatattctacatagaaacatatcctttatacttgatcaagctcttactcatcagtcctactcctgctgattttgctcacttcctctttgctacttttcaaatttagcaagagttgtgtggaggaaccataaaaagtatggcttgaattaggagaggaaaacgagtgactgaaattttgcgagaaggcaaccactacc

SEQ ID NO: 232 - DNA, 200 bp, Amaranthus palmeri
atatgtttctatgtagaatatgaatgcattacctgtagaattgacataatgatttgtctgcagtgttggcgaattttttgagcgacattttgggaaagaggtattgttgccaacttgccatgctctattccggtgaattaacaaatgttgcgcttctgcttactattgcttataattattgtttttttgcagtttgttga

SEQ ID NO: 233 - DNA, 200 bp, Amaranthus palmeri
tcaacaaactgcaaaaaaacaataattataagcaatagtaagcagaagcgcaacatttgttaattcaccggaatagagcatggcaagttggcaacaatacctctttcccaaaatgtcgctcaaaaaattcgccaacactgcagacaaatcattatgtcaattctacaggtaatgcattcatattctacatagaaacatat

SEQ ID NO: 234 - DNA, 200 bp, Amaranthus palmeri
ttattgtttttttgcagtttgttgattatgttattgacccttttgttgcgggtacatgtggtggagatcctcaatcgctatctgtaagttaaatactgtgccttctttttttttctcaaaattttctggaggttgtaaataaattatactccctcctattataatcaactgtcctatttccccttttggtatattcaaag

SEQ ID NO: 235 - DNA, 200 bp, Amaranthus palmeri
ctttgaatataccaaaaggggaaataggacagttgattataataggagggagtataatttatttacaacctccagaaaattttgagaaaaaaaaagaaggcacagtatttaacttacagatagcgattgaggatctccaccacatgtacccgcaacaaaagggtcaataacataatcaacaaactgcaaaaaaacaataa

SEQ ID NO: 236 - DNA, 200 bp, Amaranthus palmeri
atttccccttttggtatattcaaagtgagttaaatattgccatccattaaatttcactttgtcccttacttattttttcccttactcactcctctcatgtggtcccttaaactcggtgcattaccaaataggactattgattgaaataggagggagtatccgattgtgcttccaaaggtagttcaactcctcttcttttt

SEQ ID NO: 237 - DNA, 200 bp, Amaranthus palmeri
aaaaagaagaggagttgaactacctttggaagcacaatcggatactccctcctatttcaatcaatagtcctatttggtaatgcaccgagtttaagggaccacatgagaggagtgagtaagggaaaaaataagtaagggacaaagtgaaatttaatggatggcaatatttaactcactttgaatataccaaaaggggaaat

SEQ ID NO: 238 - DNA, 200 bp, Amaranthus palmeri
aggtagttcaactcctcttctttttctttaaatttttgtaccatactgtgcattttgaaccttaactcatttcgccatgaaggagtattatatttgagaagaacgcagatactattatcttatacattaggtttcattatcaatgattgtttgattgtcaactcctcttttccctttcatgctcatattgatgttatttc

SEQ ID NO: 239 - DNA, 200 bp, Amaranthus palmeri
gaaataacatcaatatgagcatgaaagggaaaagaggagttgacaatcaaacaatcattgataatgaaacctaatgtataagataatagtatctgcgttcttctcaaatataatactccttcatggcgaaatgagttaaggttcaaaatgcacagtatggtacaaaaatttaaagaaaaagaagaggagttgaactacct

SEQ ID NO: 240 - DNA, 200 bp, Amaranthus palmeri
ttcatgctcatattgatgttatttctatttggttatgaattttgtgtattgtgttaatgtcttactttattgtagatgcaccatacatttcccgacgtatggaatgttgaaaaaaggtatgaatcttaaagctttaattttcttcgaacgttatgtttcataattgattctttgggatcaatttccgtaagaacgataat

SEQ ID NO: 241 - DNA, 200 bp, Amaranthus palmeri
attatcgttcttacggaaattgatcccaaagaatcaattatgaaacataacgttcgaagaaaattaaagctttaagattcataccttttttcaacattccatacgtcgggaaatgtatggtgcatctacaataaagtaagacattaacacaatacacaaaattcataaccaaatagaaataacatcaatatgagcatgaa

SEQ ID NO: 242 - DNA, 200 bp, Amaranthus palmeri
gatcaatttccgtaagaacgataatttgaaaaaatttatgaaccttcaagctttcttcgaatttatatgctttgtaattcatgcttttagatgctgcaccattttatctatgtgtcttaagtttggtgtaatcatttgtatagcaaaagaatgaatggtctggtttgaaatggttcatagtgcaaaatgtgattgtgctt

SEQ ID NO: 243 - DNA, 200 bp, Amaranthus palmeri
aagcacaatcacattttgcactatgaaccatttcaaaccagaccattcattcttttgctatacaaatgattacaccaaacttaagacacatagataaaatggtgcagcatctaaaagcatgaattacaaagcatataaattcgaagaaagcttgaaggttcataaattttttcaaattatcgttcttacggaaattgatc

SEQ ID NO: 244 - DNA, 200 bp, Amaranthus palmeri
catagtgcaaaatgtgattgtgcttgcgattgaggtaacattcaaggtgatgcgattgtcgtactgtcaattgtcgtcctataccatgtgatatttgaataagcctaaaatgccatattgtacacctttaggatgtggacaaaatgggttcggtttcggtacatatgacaaatccttgcaatttgatctgtacgatacaa

SEQ ID NO: 245 - DNA, 200 bp, Amaranthus palmeri
ttgtatcgtacagatcaaattgcaaggatttgtcatatgtaccgaaaccgaacccattttgtccacatcctaaaggtgtacaatatggcattttaggcttattcaaatatcacatggtataggacgacaattgacagtacgacaatcgcatcaccttgaatgttacctcaatcgcaagcacaatcacattttgcactatg

SEQ ID NO: 246 - DNA, 200 bp, Amaranthus palmeri
ttgcaatttgatctgtacgatacaatgcgattttgtcttttgctttatgatggtgattccatatgcgattttagggcttagaaatttcccttgttcaagaacatctcaatcaatctttaaccaatttcaaccacattaaattgcgtcaaagtcgaactttataattcactcccaatctctgagatatccaaactccaaaa

SEQ ID NO: 247 - DNA, 200 bp, Amaranthus palmeri
ttttggagtttggatatctcagagattgggagtgaattataaagttcgactttgacgcaatttaatgtggttgaaattggttaaagattgattgagatgttcttgaacaagggaaatttctaagccctaaaatcgcatatggaatcaccatcataaagcaaaagacaaaatcgcattgtatcgtacagatcaaattgcaa

SEQ ID NO: 248 - DNA, 200 bp, Amaranthus palmeri
tctctgagatatccaaactccaaaagttctattggctttcatgttttcacaaagtaacgttggtgggactccttaccattttctttattatgcatttcgttgatgtataatagtatagattggtgctcttttcgctgtccttctaacatgcataacttcactagttcttatcgttttcttttcctccctatttttatttg

SEQ ID NO: 249 - DNA, 200 bp, Amaranthus palmeri
caaataaaaatagggaggaaaagaaaacgataagaactagtgaagttatgcatgttagaaggacagcgaaaagagcaccaatctatactattatacatcaacgaaatgcataataaagaaaatggtaaggagtcccaccaacgttactttgtgaaaacatgaaagccaatagaacttttggagtttggatatctcagaga

SEQ ID NO: 250 - DNA, 200 bp, Amaranthus palmeri
ttcttttcctccctatttttatttgacttgtagctatctatgttcactcttctcgcccaatccaatgttatcttctactccatgcttgcaaaagccacaaaatgctcactccaccaataagaggaaattgccagtccaccacttgctggaggcatccatggaagctgaagtatttttgtcctctactcataggatgcata

SEQ ID NO: 251 - DNA, 200 bp, Amaranthus palmeri
tatgcatcctatgagtagaggacaaaaatacttcagcttccatggatgcctccagcaagtggtggactggcaatttcctcttattggtggagtgagcattttgtggcttttgcaagcatggagtagaagataacattggattgggcgagaagagtgaacatagatagctacaagtcaaataaaaatagggaggaaaagaa

SEQ ID NO: 252 - DNA, 200 bp, Amaranthus palmeri
ttgtcctctactcataggatgcatacatgcatcgatttactttctaatactcctttaacttgattccgattagctctgctcttaacaggtgttgctagaaaacatcaactattttcagcataaattaaatgtgagcattacctaataacgtgaaaactatcaaatcttgtttgtagtgcaatattgcgttttcggttgcg

SEQ ID NO: 253 - DNA, 200 bp, Amaranthus palmeri
cgcaaccgaaaacgcaatattgcactacaaacaagatttgatagttttcacgttattaggtaatgctcacatttaatttatgctgaaaatagttgatgttttctagcaacacctgttaagagcagagctaatcggaatcaagttaaaggagtattagaaagtaaatcgatgcatgtatgcatcctatgagtagaggacaa

SEQ ID NO: 254 - DNA, 200 bp, Amaranthus palmeri
attattgtgtaattcttccctcacgtctctattgtcttcatttttttagaaaaataaataaagcttggttttatagattttgtaactgatatgcaatacatttgcgtttgctttcagttattgattcaaaaacaataatgctaaagccctaatcctaacatgttgtgtcatctgttgaaacaatacttgaaatcgctata

SEQ ID NO: 255 - DNA, 200 bp, Amaranthus palmeri
tatagcgatttcaagtattgtttcaacagatgacacaacatgttaggattagggctttagcattattgtttttgaatcaataactgaaagcaaacgcaaatgtattgcatatcagttacaaaatctataaaaccaagctttatttatttttctaaaaaaatgaagacaatagagacgtgagggaagaattacacaataat

SEQ ID NO: 256 - DNA, 200 bp, Amaranthus palmeri
tgaaacaatacttgaaatcgctataaaaagggatttttgtcgggtacttcagttgttgaaattgatatggtcaagtacaattcattttaacccaatttgtaatgatttactggcttggtttcttagctgtttgttttaataaaggattttagttcggtatttggttgttgaaaaaattgatatggccaagtaatggtcat

SEQ ID NO: 257 - DNA, 200 bp, Amaranthus palmeri
atgaccattacttggccatatcaattttttcaacaaccaaataccgaactaaaatcctttattaaaacaaacagctaagaaaccaagccagtaaatcattacaaattgggttaaaatgaattgtacttgaccatatcaatttcaacaactgaagtacccgacaaaaatccctttttatagcgatttcaagtattgtttca

SEQ ID NO: 258 - DNA, 200 bp, Amaranthus palmeri
attgatatggccaagtaatggtcatattaacacaattggtaatgttttattagctcaatagtgtttgttaagtatgtgactcaaatttaatcaagtataacttattgaagcgtagttcttttatccattaggtttggctctgtgtttgctggactaattcaatcaacattgttatctaagaaggaaaagggtggaggaga

SEQ ID NO: 259 - DNA, 200 bp, Amaranthus palmeri
tctcctccacccttttccttcttagataacaatgttgattgaattagtccagcaaacacagagccaaacctaatggataaaagaactacgcttcaataagttatacttgattaaatttgagtcacatacttaacaaacactattgagctaataaaacattaccaattgtgttaatatgaccattacttggccatatcaat

SEQ ID NO: 260 - DNA, 200 bp, Amaranthus palmeri
ctaagaaggaaaagggtggaggagaaaatgcttctatcaagaagcctcgtgtacgcggttcattttcattccatggtggaatgcaggtataaccttatagccataatttcgctttttataccttatacttccaaaatatattgatgcattttcttgctacaatcacaaaagctttgggaaaaattctcaattttgtcaaa

SEQ ID NO: 261 - DNA, 200 bp, Amaranthus palmeri
tttgacaaaattgagaatttttcccaaagcttttgtgattgtagcaagaaaatgcatcaatatattttggaagtataaggtataaaaagcgaaattatggctataaggttatacctgcattccaccatggaatgaaaatgaaccgcgtacacgaggcttcttgatagaagcattttctcctccacccttttccttcttag

SEQ ID NO: 262 - DNA, 200 bp, Amaranthus palmeri
gggaaaaattctcaattttgtcaaatctactaaaataattcattttggaaccaaggttttctatttcagaatacatggatgaagacatgcagtaagtatggataaaataatctagatgtaaaaggtttttagtctattaagcaagaatattataattcagagtcgtttcatcaataaagtgttgtttaagtgcagcaatt

SEQ ID NO: 263 - DNA, 200 bp, Amaranthus palmeri
aattgctgcacttaaacaacactttattgatgaaacgactctgaattataatattcttgcttaatagactaaaaaccttttacatctagattattttatccatacttactgcatgtcttcatccatgtattctgaaatagaaaaccttggttccaaaatgaattattttagtagatttgacaaaattgagaatttttccc

SEQ ID NO: 264 - DNA, 200 bp, Amaranthus palmeri
aaagtgttgtttaagtgcagcaattacattctgcttcaagcaaaggctatcttaagacttaagaggctcccaaaacatgaggaggtatgagaccttagaggccaaagaaataaaatttgatgaggagacttggtgagataccttgcttccaaaaatgatatatttttccccttagacacctcagattatgacatttataa

SEQ ID NO: 265 - DNA, 200 bp, Amaranthus palmeri
ttataaatgtcataatctgaggtgtctaaggggaaaaatatatcatttttggaagcaaggtatctcaccaagtctcctcatcaaattttatttctttggcctctaaggtctcatacctcctcatgttttgggagcctcttaagtcttaagatagcctttgcttgaagcagaatgtaattgctgcacttaaacaacacttt

SEQ ID NO: 266 - DNA, 200 bp, Amaranthus palmeri
acacctcagattatgacatttataaggtgtccctgcgtattcgacgagattttacgacctatactctaaagtctaaattgagtgagaaatgtgtatatgtgtaagaaaggaaagttagtaccatgaattccatgtctacgacctcaaagtgttcataccattgaaattagtgagcttacaattgttaagaaagcatcaac

SEQ ID NO: 267 - DNA, 200 bp, Amaranthus palmeri
gttgatgctttcttaacaattgtaagctcactaatttcaatggtatgaacactttgaggtcgtagacatggaattcatggtactaactttcctttcttacacatatacacatttctcactcaatttagactttagagtataggtcgtaaaatctcgtcgaatacgcagggacaccttataaatgtcataatctgaggtgt

SEQ ID NO: 268 - DNA, 200 bp, Amaranthus palmeri
ttacaattgttaagaaagcatcaactattcataattgatcattgatgaagtgtgtaatagacatgctaggtgaaattcgaaagggatctactctgtctttgagtttacaatttgcttctagtttttagctatttataggtgctatcaaagggttgaatattgttttttctgaacattgttgccgagttgtgaagggagaa

SEQ ID NO: 269 - DNA, 200 bp, Amaranthus palmeri
ttctcccttcacaactcggcaacaatgttcagaaaaaacaatattcaaccctttgatagcacctataaatagctaaaaactagaagcaaattgtaaactcaaagacagagtagatccctttcgaatttcacctagcatgtctattacacacttcatcaatgatcaattatgaatagttgatgctttcttaacaattgtaa

SEQ ID NO: 270 - DNA, 200 bp, Amaranthus palmeri
ttgttgccgagttgtgaagggagaatgatggtagatttctcttaatgagaacattctcttcataaagagttcgatagcgcaaaaacgaaagcttattgccaaaagtggctggggtagatgaaagagaactgcaattgattttgctaggcttgactttgagtaaagaattcatggcataaggtagaaaaataggagatggc

SEQ ID NO: 271 - DNA, 200 bp, Amaranthus palmeri
gccatctcctatttttctaccttatgccatgaattctttactcaaagtcaagcctagcaaaatcaattgcagttctctttcatctaccccagccacttttggcaataagctttcgtttttgcgctatcgaactctttatgaagagaatgttctcattaagagaaatctaccatcattctcccttcacaactcggcaacaa

SEQ ID NO: 272 - DNA, 200 bp, Amaranthus palmeri
ataaggtagaaaaataggagatggctgaatgatatcgaaaccttttgattctttttgttttgtttgcaatgcacagaaaggcaggacgggaaagtgtgattaaatggatgggaaaaattgctagaatagaaaagaagaaagatgtagcactcacgtgaggaaattacccaatatctgaatggagctcacactcctctctt

SEQ ID NO: 273 - DNA, 200 bp, Amaranthus palmeri
aagagaggagtgtgagctccattcagatattgggtaatttcctcacgtgagtgctacatctttcttcttttctattctagcaatttttcccatccatttaatcacactttcccgtcctgcctttctgtgcattgcaaacaaaacaaaaagaatcaaaaggtttcgatatcattcagccatctcctatttttctaccttat

SEQ ID NO: 274 - DNA, 200 bp, Amaranthus palmeri
tgaatggagctcacactcctctcttcctctactaatatacaacctgcctaatttgcacaatagctgctaatatcatagtagtatgagataatggctggatgtctcaattgttaccctagttttgacaactattttacgttggcatttcggtggcctggggccgtggactgagtcaccttaaaaattcatctgtgatatag

SEQ ID NO: 275 - DNA, 200 bp, Amaranthus palmeri
ctatatcacagatgaatttttaaggtgactcagtccacggccccaggccaccgaaatgccaacgtaaaatagttgtcaaaactagggtaacaattgagacatccagccattatctcatactactatgatattagcagctattgtgcaaattaggcaggttgtatattagtagaggaagagaggagtgtgagctccattca

SEQ ID NO: 276 - DNA, 200 bp, Amaranthus palmeri
ccttaaaaattcatctgtgatatagtttagaatcaattttgaaaatttaggcaggcctaaattttgataaagatagcatgatctaaagaatgcagctctaataaatttacataaaatttgatattaagtagtctctgtctaggcctgccttccgagcttgtatattaactgagcgcatgtttatttgaggaatagcatag

SEQ ID NO: 277 - DNA, 200 bp, Amaranthus palmeri
ctatgctattcctcaaataaacatgcgctcagttaatatacaagctcggaaggcaggcctagacagagactacttaatatcaaattttatgtaaatttattagagctgcattctttagatcatgctatctttatcaaaatttaggcctgcctaaattttcaaaattgattctaaactatatcacagatgaatttttaagg

SEQ ID NO: 278 - DNA, 200 bp, Amaranthus palmeri
catgtttatttgaggaatagcataggagtcatttttttgcatactaattagcatgtcaattttattccatttgctgagtactgtatgttctgcagacacttgttgacacaatgtgcaaacagcttggtgaagacgaactcaaactccagtgtgaggtgctgtccttgtcatacaaccagaaggggatcccttcattaggg

SEQ ID NO: 279 - DNA, 200 bp, Amaranthus palmeri
ccctaatgaagggatccccttctggttgtatgacaaggacagcacctcacactggagtttgagttcgtcttcaccaagctgtttgcacattgtgtcaacaagtgtctgcagaacatacagtactcagcaaatggaataaaattgacatgctaattagtatgcaaaaaaatgactcctatgctattcctcaaataaacatg

SEQ ID NO: 280 - DNA, 200 bp, Amaranthus palmeri
catgtggtggagatcctcaatcgctatctatgcaccatacatttcccgacgtatggaatgttgaaaaaaggtttggctctgtgtttgctggactaattcaatcaacattgttatctaagaaggaaaagggtggagggaaaatgcttctatcaagaagcctcgtgtacgcggttcattttcattccatggtggaatgcaga

SEQ ID NO: 281 - DNA, 200 bp, Amaranthus palmeri
tctgcattccaccatggaatgaaaatgaaccgcgtacacgaggcttcttgatagaagcattttccctccacccttttccttcttagataacaatgttgattgaattagtccagcaaacacagagccaaaccttttttcaacattccatacgtcgggaaatgtatggtgcatagatagcgattgaggatctccaccacatg

SEQ ID NO: 282 - DNA, 200 bp, Amaranthus palmeri
ttttcattccatggtggaatgcagacacttgttgacacaatgtgcaaacagcttggtgaagatgaactcaagctccagtgtgaggtgctgtccttgtcatacaaccagaaggggatcccttcattagggaattggtcagtctcttctatgtcaaataataccagtgaagatcaatcttatgatgctgtggttgtcactgc

SEQ ID NO: 283 - DNA, 200 bp, Amaranthus palmeri
gcagtgacaaccacagcatcataagattgatcttcactggtattatttgacatagaagagactgaccaattccctaatgaagggatccccttctggttgtatgacaaggacagcacctcacactggagcttgagttcatcttcaccaagctgtttgcacattgtgtcaacaagtgtctgcattccaccatggaatgaaaa

SEQ ID NO: 284 - DNA, 200 bp, Amaranthus palmeri
cttatgatgctgtggttgtcactgctccaattcgcaatgtcaaagaaatgaagattatgaaatttggaaatccattttcacttgactttattccagaggtgacttacgtacccctttccgttatgattactgcattcaagaaggataaagtgaagagacctctcgagggcttcggagttcttatcccgtctaaagagcaa

SEQ ID NO: 285 - DNA, 200 bp, Amaranthus palmeri
ttgctctttagacgggataagaactccgaagccctcgagaggtctcttcactttatccttcttgaatgcagtaatcataacggaaaggggtacgtaagtcacctctggaataaagtcaagtgaaaatggatttccaaatttcataatcttcatttctttgacattgcgaattggagcagtgacaaccacagcatcataag

SEQ ID NO: 286 - DNA, 200 bp, Amaranthus palmeri
agttcttatcccgtctaaagagcaacataatggactgaagactcttggtactttattttcgtctatgatgtttcctgatcgtgctccatctgatatgtgtctttttaccacatttgtcggaggaagcagaaatagaaaacttgcaaacgcttcaacggatgaattgaagcaaatagtttcttctgaccttcagcagctgt

SEQ ID NO: 287 - DNA, 200 bp, Amaranthus palmeri
acagctgctgaaggtcagaagaaactatttgcttcaattcatccgttgaagcgtttgcaagttttctatttctgcttcctccgacaaatgtggtaaaaagacacatatcagatggagcacgatcaggaaacatcatagacgaaaataaagtaccaagagtcttcagtccattatgttgctctttagacgggataagaact

SEQ ID NO: 288 - DNA, 200 bp, Amaranthus palmeri
gtttcttctgaccttcagcagctgttgggcactgaggacgaaccttcatttgtcaatcatctcttttggagcaatgcattcccgttgtatgggcacaattacgattctgttttgacagcaatagacaagatggaaaaggatcttcctggattttttatgcaggtaaccataagggtggactttcagtaggaaaagcgatg

SEQ ID NO: 289 - DNA, 200 bp, Amaranthus palmeri
catcgcttttcctactgaaagtccacccttatggttacctgcataaaaaatccaggaagatccttttccatcttgtctattgctgtcaaaacagaatcgtaattgtgcccatacaacgggaatgcattgctccaaaagagatgattgacaaatgaaggttcgtcctcagtgcccaacagctgctgaaggtcagaagaaac

SEQ ID NO: 290 - DNA, 200 bp, Amaranthus palmeri
ggggagcgggttgctggataaccagagagagtgcaagagagatgagtgccatggcgttatcgagcagcattctacaatgtccgccgcactccgacatctctttccgcttttctgcttatacaccaacccgctcccccatcttcttcggaagacctcgaaaattatcatatatccattgttccacaagctcaagctcaact

SEQ ID NO: 291 - DNA, 200 bp, Amaranthus palmeri
agttgagcttgagcttgtggaacaatggatatatgataattttcgaggtcttccgaagaagatgggggagcgggttggtgtataagcagaaaagcggaaagagatgtcggagtgcggcggacattgtagaatgctgctcgataacgccatggcactcatctctcttgcactctctctggttatccagcaacccgctcccc

SEQ ID NO: 292 - DNA, 200 bp, Amaranthus palmeri
ggtgtttatttgggcatggccttatgtgtgatgttggtaaattttgtggcttcgtccactaatctgatgtatcggatctgttaaagggagccctctcatcctatgcttatcaatgactttttcatatgcctatcaaacagatcagattggatcgggttcgagttcaggtcatatataaacatgtcagcaaacccttgacc

SEQ ID NO: 293 - DNA, 200 bp, Amaranthus palmeri
ggtcaagggtttgctgacatgtttatatatgacctgaactcgaacccgatccaatctgatctgtttgataggcatatgaaaaagtcattgataagcataggatgagagggctccctttaacagatccgatacatcagattagtggacgaagccacaaaatttaccaacatcacacataaggccatgcccaaataaacacc

SEQ ID NO: 294 - DNA, 200 bp, Amaranthus palmeri
taaacatgtcagcaaacccttgacccatacccaacccatttagttaattggcttgaaaatcacaaccttaattcgaccagcgacagatcaggttgacctgatttcgacccacttaacccatttataatttttttttcgatttaagttttttaacattgattaaatctaattttttaggctttaattttaattttatgttt

SEQ ID NO: 295 - DNA, 200 bp, Amaranthus palmeri
aaacataaaattaaaattaaagcctaaaaaattagatttaatcaatgttaaaaaacttaaatcgaaaaaaaaattataaatgggttaagtgggtcgaaatcaggtcaacctgatctgtcgctggtcgaattaaggttgtgattttcaagccaattaactaaatgggttgggtatgggtcaagggtttgctgacatgttta

SEQ ID NO: 296 - DNA, 200 bp, Amaranthus palmeri
aggctttaattttaattttatgtttttttgtttaatttgtatttactatgaaaaataagaaactattatatgaactgagtttagcttacacttattaatttaactcgaaattaacacatttaattaaatggttatatagggttttttagttttaaaatttcaacctgaacctaatctatttaataaaaagatcagatctg

SEQ ID NO: 297 - DNA, 200 bp, Amaranthus palmeri
cagatctgatctttttattaaatagattaggttcaggttgaaattttaaaactaaaaaaccctatataaccatttaattaaatgtgttaatttcgagttaaattaataagtgtaagctaaactcagttcatataatagtttcttatttttcatagtaaatacaaattaaacaaaaaaacataaaattaaaattaaagcct

SEQ ID NO: 298 - DNA, 200 bp, Amaranthus palmeri
ctatttaataaaaagatcagatctgatcaacccatataattaattgggtcaaaatctcaactcaaacccatttatttcgaattaaattcagatcaaattagcaggtcggatcaactagcgctaatttttcctctcaagttttttcatatgatgccccttgttttctttgaataaaattcaccaatttaaaatccctgccc

SEQ ID NO: 299 - DNA, 200 bp, Amaranthus palmeri
gggcagggattttaaattggtgaattttattcaaagaaaacaaggggcatcatatgaaaaaacttgagaggaaaaattagcgctagttgatccgacctgctaatttgatctgaatttaattcgaaataaatgggtttgagttgagattttgacccaattaattatatgggttgatcagatctgatctttttattaaatag

SEQ ID NO: 300 - DNA, 200 bp, Amaranthus palmeri
attcaccaatttaaaatccctgcccttgatccgttggtattggtatttggtaaagcacatatggtaaattctactccattgttatctgtagttttggttctaaaccccaaacaaatcctactcctagcaccactaatcctcattactttctgtttgctgtctttctctacattcctactaaattaagacctagatgcagt

SEQ ID NO: 301 - DNA, 200 bp, Amaranthus palmeri
actgcatctaggtcttaatttagtaggaatgtagagaaagacagcaaacagaaagtaatgaggattagtggtgctaggagtaggatttgtttggggtttagaaccaaaactacagataacaatggagtagaatttaccatatgtgctttaccaaataccaataccaacggatcaagggcagggattttaaattggtgaat

SEQ ID NO: 302 - DNA, 200 bp, Amaranthus palmeri
tactaaattaagacctagatgcagtgttattctgttcgaggttgccgaaaacggtacaatagttgcctaatttgcaattcatgtttgttcttgcgttttctacattgtttactctattggaacaaaggttgaactttcagcctttcagggagtattttgatttttctgtcaaattaccttgccagatttatttggctatt

SEQ ID NO: 303 - DNA, 200 bp, Amaranthus palmeri
aatagccaaataaatctggcaaggtaatttgacagaaaaatcaaaatactccctgaaaggctgaaagttcaacctttgttccaatagagtaaacaatgtagaaaacgcaagaacaaacatgaattgcaaattaggcaactattgtaccgttttcggcaacctcgaacagaataacactgcatctaggtcttaatttagta

SEQ ID NO: 304 - DNA, 200 bp, Amaranthus palmeri
accttgccagatttatttggctattttgattgtgtgtatttctttgtcccttgtttccatggggctaaactccttttggttaatcttaaacatttcttctaattttgaattgcagtggtatgaagtgttgtttaatatacaatcaatttttctgaactgggttaatgaagagaagcattgtagacatgaggaatgtgttc

SEQ ID NO: 305 - DNA, 200 bp, Amaranthus palmeri
gaacacattcctcatgtctacaatgcttctcttcattaacccagttcagaaaaattgattgtatattaaacaacacttcataccactgcaattcaaaattagaagaaatgtttaagattaaccaaaaggagtttagccccatggaaacaagggacaaagaaatacacacaatcaaaatagccaaataaatctggcaaggt

SEQ ID NO: 306 - DNA, 200 bp, Amaranthus palmeri
cattgtagacatgaggaatgtgttcaagcatctcaaaacaaccaaattaatcccaaatgggatcttcaactgtaatagaggtaaatcacatatattctcatttaatggttattgttttattttaaggatgttattatgttgttatcaatgatagaaataagagaagcttgagcattcaaatgtatctatcactcactggt

SEQ ID NO: 307 - DNA, 200 bp, Amaranthus palmeri
accagtgagtgatagatacatttgaatgctcaagcttctcttatttctatcattgataacaacataataacatccttaaaataaaacaataaccattaaatgagaatatatgtgatttacctctattacagttgaagatcccatttgggattaatttggttgttttgagatgcttgaacacattcctcatgtctacaatg

SEQ ID NO: 308 - DNA, 200 bp, Amaranthus palmeri
tcaaatgtatctatcactcactggttgtggacatctaaaatatggaccaagagttttcttcatttcttgtaccagaatttgcaaatgtatgattaaagtttaggttggagttgcaataaaatttcattaccccgacgctattaagtggctcacactgaggcggggtttgagggtcggatggtgcaaccttcaggagaggt

SEQ ID NO: 309 - DNA, 200 bp, Amaranthus palmeri
acctctcctgaaggttgcaccatccgaccctcaaaccccgcctcagtgtgagccacttaatagcgtcggggtaatgaaattttattgcaactccaacctaaactttaatcatacatttgcaaattctggtacaagaaatgaagaaaactcttggtccatattttagatgtccacaaccagtgagtgatagatacatttga

SEQ ID NO: 310 - DNA, 200 bp, Amaranthus palmeri
ggatggtgcaaccttcaggagaggttctaagcattttcaacatgttcaaccgcagagggtcccgtaaaattggaggcttcaatattaaattatgtagtatgtgttaagtgtttaaagatataaaaatgttaatgaatacataatttttaaaattgcacagggctttcaaagaaatttttgattttgctccgcccatggca

SEQ ID NO: 311 - DNA, 200 bp, Amaranthus palmeri
tgccatgggcggagcaaaatcaaaaatttctttgaaagccctgtgcaattttaaaaattatgtattcattaacatttttatatctttaaacacttaacacatactacataatttaatattgaagcctccaattttacgggaccctctgcggttgaacatgttgaaaatgcttagaacctctcctgaaggttgcaccatcc

SEQ ID NO: 312 - DNA, 200 bp, Amaranthus palmeri
ttttgattttgctccgcccatggcaacctttggcaaatctggatagaattagagaaatttacttttatgtatgtataatctgatgaatgaatgaatgaacaatgaagttcatttctgagtcaatgacctatatactatcgaggtttcgttaaataggatatataaataaaattagagacatcttttatccctaatgttgt

SEQ ID NO: 313 - DNA, 200 bp, Amaranthus palmeri
acaacattagggataaaagatgtctctaattttatttatatatcctatttaacgaaacctcgatagtatataggtcattgactcagaaatgaacttcattgttcattcattcattcatcagattatacatacataaaagtaaatttctctaattctatccagatttgccaaaggttgccatgggcggagcaaaatcaaaa

SEQ ID NO: 314 - DNA, 200 bp, Amaranthus palmeri
agacatcttttatccctaatgttgtctgttttcttttctgggcgagactgtttttggagaaaaacgttatgttgaatgcttgatttactcagaactgatgcaaacagatggataaaaaatggtgttttcctagtgtttatgtttcataaaaggatttcaaattccaatcgtatgaagtttgaaatactgctttttgtttt

SEQ ID NO: 315 - DNA, 200 bp, Amaranthus palmeri
aaaacaaaaagcagtatttcaaacttcatacgattggaatttgaaatccttttatgaaacataaacactaggaaaacaccattttttatccatctgtttgcatcagttctgagtaaatcaagcattcaacataacgtttttctccaaaaacagtctcgcccagaaaagaaaacagacaacattagggataaaagatgtct

SEQ ID NO: 316 - DNA, 200 bp, Amaranthus palmeri
agtttgaaatactgctttttgtttttgtagcttcgtgttttgctttccttcactcttcaccagggaacgttgttgaagtttgttccaagaagcaagaagtcgtaattgcaatcgggagcaatgttggtgacagattagaaaatttcaaccaagctctgcaacaaatgaagaaattaggcatagacatcacaaggcatggt

SEQ ID NO: 317 - DNA, 200 bp, Amaranthus palmeri
accatgccttgtgatgtctatgcctaatttcttcatttgttgcagagcttggttgaaattttctaatctgtcaccaacattgctcccgattgcaattacgacttcttgcttcttggaacaaacttcaacaacgttccctggtgaagagtgaaggaaagcaaaacacgaagctacaaaaacaaaaagcagtatttcaaact

SEQ ID NO: 318 - DNA, 200 bp, Amaranthus palmeri
aggcatagacatcacaaggcatggttgtttatatgagacggaacctgcatacgtgactgatcaaccgaagtttcttaactctgctttaagaggctttacaagacttggacctcatgaattattaggggtattgaagaaaattgagaaggatatgggtagaaccaagggaataaggtatggtcctaggccaattgacttgg

SEQ ID NO: 319 - DNA, 200 bp, Amaranthus palmeri
ccaagtcaattggcctaggaccataccttattcccttggttctacccatatccttctcaattttcttcaatacccctaataattcatgaggtccaagtcttgtaaagcctcttaaagcagagttaagaaacttcggttgatcagtcacgtatgcaggttccgtctcatataaacaaccatgccttgtgatgtctatgcct

SEQ ID NO: 320 - DNA, 200 bp, Amaranthus palmeri
tatggtcctaggccaattgacttggacatactattttatgggaagtttagggtgagctctgagagcctcactatcccccatgaaaggatatgggaaagaccatttgtgatggcaccattgattgattgtattgggtctgatgtagaaaatgacactatttgtacgtggcattcattatcaaatttttcgggtggaatctt

SEQ ID NO: 321 - DNA, 200 bp, Amaranthus palmeri
aagattccacccgaaaaatttgataatgaatgccacgtacaaatagtgtcattttctacatcagacccaatacaatcaatcaatggtgccatcacaaatggtctttcccatatcctttcatgggggatagtgaggctctcagagctcaccctaaacttcccataaaatagtatgtccaagtcaattggcctaggaccata

SEQ ID NO: 322 - DNA, 200 bp, Amaranthus palmeri
tatcaaatttttcgggtggaatctttgaagcatggggtaaactcggtggaagctccctaatcgggaaggatggaatgaaaagggttttgcccgttggaaatctcttatgggattggtctcataaaacctctgttatgggagtcttgaacttgactcctgatagctttagtgatggcggaagttttcaatctgtcaatact

SEQ ID NO: 323 - DNA, 200 bp, Amaranthus palmeri
agtattgacagattgaaaacttccgccatcactaaagctatcaggagtcaagttcaagactcccataacagaggttttatgagaccaatcccataagagatttccaacgggcaaaacccttttcattccatccttcccgattagggagcttccaccgagtttaccccatgcttcaaagattccacccgaaaaatttgata

SEQ ID NO: 324 - DNA, 200 bp, Amaranthus palmeri
cggaagttttcaatctgtcaatactgcggttgctaaggttcgtcagatgatctcagatggggcagatataattgacatcggggcacaatcaaccagacccatggcaactagaatttcggctgaagaagagctagcaagagtagtacctgtattagaagctgtcaaggatttgatcgaggaagaaggaagaatcttgtcag

SEQ ID NO: 325 - DNA, 200 bp, Amaranthus palmeri
ctgacaagattcttccttcttcctcgatcaaatccttgacagcttctaatacaggtactactcttgctagctcttcttcagccgaaattctagttgccatgggtctggttgattgtgccccgatgtcaattatatctgccccatctgagatcatctgacgaaccttagcaaccgcagtattgacagattgaaaacttccg

SEQ ID NO: 326 - DNA, 200 bp, Amaranthus palmeri
gaggaagaaggaagaatcttgtcagtggatacgttttattctaaagttgctttggaggccgtcaagaagggggcacacattgtgaatgatgtctctagtggtaaactcgattccgagatgtttaatgttgttgcggaccttaaagttccttatatagcaatgcacatgcgaggagatccgacttcaatgcaaaactctga

SEQ ID NO: 327 - DNA, 200 bp, Amaranthus palmeri
tcagagttttgcattgaagtcggatctcctcgcatgtgcattgctatataaggaactttaaggtccgcaacaacattaaacatctcggaatcgagtttaccactagagacatcattcacaatgtgtgcccccttcttgacggcctccaaagcaactttagaataaaacgtatccactgacaagattcttccttcttcctc

SEQ ID NO: 328 - DNA, 200 bp, Amaranthus palmeri
atccgacttcaatgcaaaactctgagaacttgacctacaatgatgtttgtaagcaagtggcttcggagttgagttctagggtcatagatgcagaattatcgggaattcctgcttggaggatagttattgatcccggcatcggattttctaagaatacgaatcaaaatttggaaattcttagtggtttacaaaagatacgg

SEQ ID NO: 329 - DNA, 200 bp, Amaranthus palmeri
ccgtatcttttgtaaaccactaagaatttccaaattttgattcgtattcttagaaaatccgatgccgggatcaataactatcctccaagcaggaattcccgataattctgcatctatgaccctagaactcaactccgaagccacttgcttacaaacatcattgtaggtcaagttctcagagttttgcattgaagtcggat

SEQ ID NO: 330 - DNA, 200 bp, Amaranthus palmeri
tcttagtggtttacaaaagatacgggaagagatagctaagaagagtttggcggtggctcattgccccttgctaattggaccttcaagaaagaggtttctgggcgagatttgtgagcgccctgtagcagctgacagggatcctgctaccattgcttctataactgctggagttttaggtggtgcaaacattgtaagagtac

SEQ ID NO: 331 - DNA, 200 bp, Amaranthus palmeri
gtactcttacaatgtttgcaccacctaaaactccagcagttatagaagcaatggtagcaggatccctgtcagctgctacagggcgctcacaaatctcgcccagaaacctctttcttgaaggtccaattagcaaggggcaatgagccaccgccaaactcttcttagctatctcttcccgtatcttttgtaaaccactaaga

SEQ ID NO: 332 - DNA, 200 bp, Amaranthus palmeri
ggtggtgcaaacattgtaagagtacataatgttagggataaccttgatgctgtcaagttatgtgatgccatactcggaaaaactgattaactgcttgtttgtaccaccttgtgaatgatgtctagtggaaggttcgattgggattatgatgaagtccgttagtttgctcgaaagaagagctttagcccgtaaggttatag

SEQ ID NO: 333 - DNA, 200 bp, Amaranthus palmeri
ctataaccttacgggctaaagctcttctttcgagcaaactaacggacttcatcataatcccaatcgaaccttccactagacatcattcacaaggtggtacaaacaagcagttaatcagtttttccgagtatggcatcacataacttgacagcatcaaggttatccctaacattatgtactcttacaatgtttgcaccacc

SEQ ID NO: 334 - DNA, 200 bp, Amaranthus palmeri
agagctttagcccgtaaggttatagttcttacagatgtagaatcattggctatttgcctatttctgcttagaagatcatagcattgatccagactttggattccatgtagaattatgttgcgactcatggtcgaattggccctttgaggaattgttgaagttccttgagtctatggttcaatcggctcggttcgatgaag

SEQ ID NO: 335 - DNA, 200 bp, Amaranthus palmeri
cttcatcgaaccgagccgattgaaccatagactcaaggaacttcaacaattcctcaaagggccaattcgaccatgagtcgcaacataattctacatggaatccaaagtctggatcaatgctatgatcttctaagcagaaataggcaaatagccaatgattctacatctgtaagaactataaccttacgggctaaagctct

SEQ ID NO: 336 - DNA, 200 bp, Amaranthus palmeri
gttcaatcggctcggttcgatgaaggttggactgtgtcgagacaagatgggtcaaagagaccaatggacaagaagtcgaccttgggcaagcttgatcaagttacttggacgagcagataacagcaggctctggcgagcattagacatacatatcatttgttttttgaagtcagatctgcaatcaatcagttgcaatggac

SEQ ID NO: 337 - DNA, 200 bp, Amaranthus palmeri
gtccattgcaactgattgattgcagatctgacttcaaaaaacaaatgatatgtatgtctaatgctcgccagagcctgctgttatctgctcgtccaagtaacttgatcaagcttgcccaaggtcgacttcttgtccattggtctctttgacccatcttgtctcgacacagtccaaccttcatcgaaccgagccgattgaac

SEQ ID NO: 338 - DNA, 200 bp, Amaranthus palmeri
ctgcaatcaatcagttgcaatggacagaccatatacggttgttagttgttcctgtcactctttgagttgaattagatcatgcaaacactgtaagagtcttgattttgtgaagctatgtgatactgtacttctcaaaatgaaatctttgatatgatgttagcttcaagagttgtttttccccccctcacattctgttctat

SEQ ID NO: 339 - DNA, 200 bp, Amaranthus palmeri
atagaacagaatgtgagggggggaaaaacaactcttgaagctaacatcatatcaaagatttcattttgagaagtacagtatcacatagcttcacaaaatcaagactcttacagtgtttgcatgatctaattcaactcaaagagtgacaggaacaactaacaaccgtatatggtctgtccattgcaactgattgattgcag

SEQ ID NO: 340 - DNA, 200 bp, Amaranthus palmeri
ttccccccctcacattctgttctatgttgtattgttgtgtgctttttggaattgtattcctgtaattagaattattcctgcaaaatggtattcctttatatcatcaaaggagtttttgtacttctaatcattgatctttagatgcaaaactgaattaatacaagtgttcttgatgaaggcttattgaagaactcactttt

SEQ ID NO: 341 - DNA, 200 bp, Amaranthus palmeri
aaaagtgagttcttcaataagccttcatcaagaacacttgtattaattcagttttgcatctaaagatcaatgattagaagtacaaaaactcctttgatgatataaaggaataccattttgcaggaataattctaattacaggaatacaattccaaaaagcacacaacaatacaacatagaacagaatgtgagggggggaa

SEQ ID NO: 342 - DNA, 200 bp, Amaranthus palmeri
aaggcttattgaagaactcactttttatttatgtctaaacttgttaaagatgttctgcttccgcccttgccacgggatgtcgggattgactaagggtggtaatcgagggattcctatgcttgaattgactcgtttaagattttgcgttgattttaagtcaaatgttttgctaagcataaactattctagctcgacttgaa

SEQ ID NO: 343 - DNA, 200 bp, Amaranthus palmeri
ttcaagtcgagctagaatagtttatgcttagcaaaacatttgacttaaaatcaacgcaaaatcttaaacgagtcaattcaagcataggaatccctcgattaccacccttagtcaatcccgacatcccgtggcaagggcggaagcagaacatctttaacaagtttagacataaataaaaagtgagttcttcaataagcctt

SEQ ID NO: 344 - DNA, 200 bp, Amaranthus palmeri
ataaactattctagctcgacttgaataatgaagttttcgagtcaagtccgagctgttctgtaagtttatgtatcttgaagcttcttagttcttacttcttatccttatttgtttgacacattgaaccgcgttgatgcttgcttgactcaacccgttaaagtcttgaattcatcacgaattcgagtcgagcaagtttaaac

SEQ ID NO: 345 - DNA, 200 bp, Amaranthus palmeri
gtttaaacttgctcgactcgaattcgtgatgaattcaagactttaacgggttgagtcaagcaagcatcaacgcggttcaatgtgtcaaacaaataaggataagaagtaagaactaagaagcttcaagatacataaacttacagaacagctcggacttgactcgaaaacttcattattcaagtcgagctagaatagtttat

SEQ ID NO: 346 - DNA, 200 bp, Amaranthus palmeri
gaattcgagtcgagcaagtttaaacccaacattaactaagctctcgaggcttaatgaggcaggggtagctcaagtttgttattcaagcaacttaccatagtattcttttaaaaggcatatagtcagttagttatttgttaatttcagtagaacgaaagaagtacattattaaacttggccattgatgcttgagctagaga

SEQ ID NO: 347 - DNA, 200 bp, Amaranthus palmeri
tctctagctcaagcatcaatggccaagtttaataatgtacttctttcgttctactgaaattaacaaataactaactgactatatgccttttaaaagaatactatggtaagttgcttgaataacaaacttgagctacccctgcctcattaagcctcgagagcttagttaatgttgggtttaaacttgctcgactcgaattc

SEQ ID NO: 348 - DNA, 200 bp, Amaranthus palmeri
tggccattgatgcttgagctagagagcttcggttgtgatcgaaacgaatcctgatttcgctcttgatctttgatgtgaagtgacaaggccttcataaaactcctttattcttcagcagtgcatacaaaaatcatgtgtgcccagctcctagctcacataccgcgtttttcccctaatctagtgtggtcaaataaaaacag

SEQ ID NO: 349 - DNA, 200 bp, Amaranthus palmeri
ctgtttttatttgaccacactagattaggggaaaaacgcggtatgtgagctaggagctgggcacacatgatttttgtatgcactgctgaagaataaaggagttttatgaaggccttgtcacttcacatcaaagatcaagagcgaaatcaggattcgtttcgatcacaaccgaagctctctagctcaagcatcaatggcca

SEQ ID NO: 350 - DNA, 200 bp, Amaranthus palmeri
atctagtgtggtcaaataaaaacagcaagatgtgttgatgtcatgtgcaatagtaattatcaggtgaagtaatgcaatatgtagccagtcacctcatatcaaaaaaatgttgggaggaaaacgtattcgttcatcactaaacctgtgtttatacatctaactgatcgatcagggtttcaaaatccaaattaatacaatgg

SEQ ID NO: 351 - DNA, 200 bp, Amaranthus palmeri
ccattgtattaatttggattttgaaaccctgatcgatcagttagatgtataaacacaggtttagtgatgaacgaatacgttttcctcccaacatttttttgatatgaggtgactggctacatattgcattacttcacctgataattactattgcacatgacatcaacacatcttgctgtttttatttgaccacactagat

SEQ ID NO: 352 - DNA, 200 bp, Amaranthus palmeri
ttcaaaatccaaattaatacaatggcatttgacgaagatatccagaacacatcccccttgtttctgctagataatcaactattctgattctgctgtaatacctcagcttcggccctagccatgggatcgtcctctttttctccttcacgctcctcggccagtttctttctgtgcagttcttcagcagcttctattgaagc

SEQ ID NO: 353 - DNA, 200 bp, Amaranthus palmeri
gcttcaatagaagctgctgaagaactgcacagaaagaaactggccgaggagcgtgaaggagaaaaagaggacgatcccatggctagggccgaagctgaggtattacagcagaatcagaatagttgattatctagcagaaacaagggggatgtgttctggatatcttcgtcaaatgccattgtattaatttggattttgaa

SEQ ID NO: 354 - DNA, 200 bp, Amaranthus palmeri
gttcttcagcagcttctattgaagctttgttctcggcctgaagacgctgcatttcctcttccatttgctgcctctcaaaccatgtatcagcatccgcccaaactgcagacaagtatacaaaagttaaataacgaaagtcttcaaaactgcagatccagtgaacaaagtcattgttgccaatgcccatgcaaaccgcaaaa

SEQ ID NO: 355 - DNA, 200 bp, Amaranthus palmeri
ttttgcggtttgcatgggcattggcaacaatgactttgttcactggatctgcagttttgaagactttcgttatttaacttttgtatacttgtctgcagtttgggcggatgctgatacatggtttgagaggcagcaaatggaagaggaaatgcagcgtcttcaggccgagaacaaagcttcaatagaagctgctgaagaac

SEQ ID NO: 356 - DNA, 200 bp, Amaranthus palmeri
gccaatgcccatgcaaaccgcaaaacagcagggcaaaagaacacaacattgcagcataaagagcaagttcagtgatctacagttactacaaaatttaggtttgggataccagcatgtcaatatgaatgaatttgctaatacatgtaacccaagaactataagtctataactaacaattaagaaaagaaaaccagaagttc

SEQ ID NO: 357 - DNA, 200 bp, Amaranthus palmeri
gaacttctggttttcttttcttaattgttagttatagacttatagttcttgggttacatgtattagcaaattcattcatattgacatgctggtatcccaaacctaaattttgtagtaactgtagatcactgaacttgctctttatgctgcaatgttgtgttcttttgccctgctgttttgcggtttgcatgggcattggc

SEQ ID NO: 358 - DNA, 200 bp, Amaranthus palmeri
attaagaaaagaaaaccagaagttccctaccactggagtattagcaaggtaacgactgcctgctgataagaattattggcctggaagtctggaactatgtgatgatcaacatgtgttgctattctaggtaaaactaatctatcataatataattaaactacaggccccagaattggggtcctgagctattgatcatgctg

SEQ ID NO: 359 - DNA, 200 bp, Amaranthus palmeri
cagcatgatcaatagctcaggaccccaattctggggcctgtagtttaattatattatgatagattagttttacctagaatagcaacacatgttgatcatcacatagttccagacttccaggccaataattcttatcagcaggcagtcgttaccttgctaatactccagtggtagggaacttctggttttcttttcttaat

SEQ ID NO: 360 - DNA, 200 bp, Amaranthus palmeri
gggtcctgagctattgatcatgctgttaaagcaaaagagttgggctgaatgagactagcaattaaaagcataggatacactgaacaatgcttccccctccccatccaaacacgtaggttttagttacacaatagtggcttgagctagaaaaccataaggatatcatagtggacacatcatagttaagttttacataaata

SEQ ID NO: 361 - DNA, 200 bp, Amaranthus palmeri
tatttatgtaaaacttaactatgatgtgtccactatgatatccttatggttttctagctcaagccactattgtgtaactaaaacctacgtgtttggatggggagggggaagcattgttcagtgtatcctatgcttttaattgctagtctcattcagcccaactcttttgctttaacagcatgatcaatagctcaggaccc

SEQ ID NO: 362 - DNA, 200 bp, Amaranthus palmeri
atcatagttaagttttacataaatataccttatacatgtataagcaatacatttccaggttgataggtcagttttatgtctatattgatcgccattctattatgagggaattatattccaataatgggtaatcatcaatgagcagtatttataggaatttattgatagcgtttctattattaggatatagaaattccaat

SEQ ID NO: 363 - DNA, 200 bp, Amaranthus palmeri
attggaatttctatatcctaataatagaaacgctatcaataaattcctataaatactgctcattgatgattacccattattggaatataattccctcataatagaatggcgatcaatatagacataaaactgacctatcaacctggaaatgtattgcttatacatgtataaggtatatttatgtaaaacttaactatgat

SEQ ID NO: 364 - DNA, 200 bp, Amaranthus palmeri
taaaaatgacgttaaatatattttatttttattttgttaatttatgtgttttaattataaagtattaaaaaatacgatgattaataagatactgctacatagacaacttaacctctcaaattggtcaaacccttaaacttaacggttaactaacgttttccattaagtgatagtcatttgcagagatttatattagatta

SEQ ID NO: 365 - DNA, 200 bp, Amaranthus palmeri
taatctaatataaatctctgcaaatgactatcacttaatggaaaacgttagttaaccgttaagtttaagggtttgaccaatttgagaggttaagttgtctatgtagcagtatcttattaatcatcgtattttttaatactttataattaaaacacataaattaacaaaataaaaataaaatatatttaacgtcattttta

SEQ ID NO: 366 - DNA, 200 bp, Amaranthus palmeri
atttgcagagatttatattagattaggtagttttttgcaaaaaaaaaaattacattaggtagttttttgcaaatagacctatagattaggcagtttcttataatttttccttcttattatttgttgtttcagatatggcttcaagaatgaagtttggtaaccaaacttttcaaatttgaagtgagggttggagctctggt

SEQ ID NO: 367 - DNA, 200 bp, Amaranthus palmeri
accagagctccaaccctcacttcaaatttgaaaagtttggttaccaaacttcattcttgaagccatatctgaaacaacaaataataagaaggaaaaattataagaaactgcctaatctataggtctatttgcaaaaaactacctaatgtaatttttttttttgcaaaaaactacctaatctaatataaatctctgcaaat

SEQ ID NO: 368 - DNA, 200 bp, Amaranthus palmeri
ttgaagtgagggttggagctctggtgttggaagccttttttgtaacaccccaaaaattttaggcaaactttatacgtttgtttatccaaaaaaaaaataataaataaataaaaaaaaaaaaattcttaaagtagaaccacttaagggtcggaggtctaggtaataattttggagtgataaatgtaaagattgaagagttt

SEQ ID NO: 369 - DNA, 200 bp, Amaranthus palmeri
aaactcttcaatctttacatttatcactccaaaattattacctagacctccgacccttaagtggttctactttaagaatttttttttttttatttatttattattttttttttggataaacaaacgtataaagtttgcctaaaatttttggggtgttacaaaaaaggcttccaacaccagagctccaaccctcacttcaa

SEQ ID NO: 370 - DNA, 200 bp, Amaranthus palmeri
gataaatgtaaagattgaagagtttgtaactcataccattagttcactcatttacctcaatttatgattataattaagtattacaaaaaaaaggggaaacaatcacttcatattccaaaggtgaagcttttaatagtgaaggaaaaggatttcttaagcaatacagtattaaacgtaaactaaaaaaaataataaatcat

SEQ ID NO: 371 - DNA, 200 bp, Amaranthus palmeri
atgatttattattttttttagtttacgtttaatactgtattgcttaagaaatccttttccttcactattaaaagcttcacctttggaatatgaagtgattgtttccccttttttttgtaatacttaattataatcataaattgaggtaaatgagtgaactaatggtatgagttacaaactcttcaatctttacatttatc

SEQ ID NO: 372 - DNA, 200 bp, Amaranthus palmeri
taaactaaaaaaaataataaatcatatcttaattttgagaagttttattcttaatttgtttatccctatcaatactaagcttgggataataaacaaagggttatcaaggttggaggatttttaatttcgagattatatacttgaattgaagaaattttatgttcaagagaattatattagaggaatatttgtaaggctat

SEQ ID NO: 373 - DNA, 200 bp, Amaranthus palmeri
atagccttacaaatattcctctaatataattctcttgaacataaaatttcttcaattcaagtatataatctcgaaattaaaaatcctccaaccttgataaccctttgtttattatcccaagcttagtattgatagggataaacaaattaagaataaaacttctcaaaattaagatatgatttattattttttttagttta

SEQ ID NO: 374 - DNA, 200 bp, Amaranthus palmeri
attagaggaatatttgtaaggctattatctacaattcttcatatttctctaattgaaatatatataaaggtaactagtttaccctctcttttcttaattcatatacattgttattttttttattatatggaaaatataaaacggaaaaaaaaatgtaaattaaacttatcttagttttgagataattgatgttatatagt

SEQ ID NO: 375 - DNA, 200 bp, Amaranthus palmeri
actatataacatcaattatctcaaaactaagataagtttaatttacatttttttttccgttttatattttccatataataaaaaaaataacaatgtatatgaattaagaaaagagagggtaaactagttacctttatatatatttcaattagagaaatatgaagaattgtagataatagccttacaaatattcctctaat

SEQ ID NO: 376 - DNA, 200 bp, Amaranthus palmeri
tttgagataattgatgttatatagtcttataatgttgattaacgttgaaaattgaattacaaaactaaataatttaaacatatgatttgttaacttctactaattaaatcttggttaggggtgatttagttgatttgagaaatatccaaataaataattagattagtttggtgaaataatatttttttttgacttcgaaa

SEQ ID NO: 377 - DNA, 200 bp, Amaranthus palmeri
tttcgaagtcaaaaaaaaatattatttcaccaaactaatctaattatttatttggatatttctcaaatcaactaaatcacccctaaccaagatttaattagtagaagttaacaaatcatatgtttaaattatttagttttgtaattcaattttcaacgttaatcaacattataagactatataacatcaattatctcaaa

SEQ ID NO: 378 - DNA, 200 bp, Amaranthus palmeri
ataatatttttttttgacttcgaaaacaatgggttaatttggcacactaatttggaatgtacaaataagttcattagagtagagcttcttaaattatgttttggtatagttaaaagtgatgttaatgtatggttaatattttataaatattttatatattttgtttagttgaattggccacttaatgaatttgtacattg

SEQ ID NO: 379 - DNA, 200 bp, Amaranthus palmeri
caatgtacaaattcattaagtggccaattcaactaaacaaaatatataaaatatttataaaatattaaccatacattaacatcacttttaactataccaaaacataatttaagaagctctactctaatgaacttatttgtacattccaaattagtgtgccaaattaacccattgttttcgaagtcaaaaaaaaatattat

SEQ ID NO: 380 - DNA, 200 bp, Amaranthus palmeri
ggccacttaatgaatttgtacattgctgttaaaaaaaaagagaggatattaatcgtttggtacaacagcataattgagcaaatcataaatctgccaaaattcaagtaattaaaaataattatcaattaacagttatacaagtgtatgtatgtggcattagcctaattgattgcgcaaggactaaataattacttattcag

SEQ ID NO: 381 - DNA, 200 bp, Amaranthus palmeri
ctgaataagtaattatttagtccttgcgcaatcaattaggctaatgccacatacatacacttgtataactgttaattgataattatttttaattacttgaattttggcagatttatgatttgctcaattatgctgttgtaccaaacgattaatatcctctctttttttttaacagcaatgtacaaattcattaagtggcc

SEQ ID NO: 382 - DNA, 200 bp, Amaranthus palmeri
aaggactaaataattacttattcaggtaatttagtattttatccaggttaattagaggttagttgagttgattatgatcaatattttggttaaatataaattttggcaaagaaaaatgagtattaatattgtatttattttgagactcgacaatttttagttgaattgttactttctaagatgttaagagtgttgttgac

SEQ ID NO: 383 - DNA, 200 bp, Amaranthus palmeri
gtcaacaacactcttaacatcttagaaagtaacaattcaactaaaaattgtcgagtctcaaaataaatacaatattaatactcatttttctttgccaaaatttatatttaaccaaaatattgatcataatcaactcaactaacctctaattaacctggataaaatactaaattacctgaataagtaattatttagtcctt

SEQ ID NO: 384 - DNA, 200 bp, Amaranthus palmeri
tcaaattggtcaaacccttaaacgatcaactaacgttttccattaagtggtagtcatttgcaaagaaatatattatattatgtagttttttacaaaaaaagaaaactacattaggcagttttttgcaaatagacctattagattttttttttaatttttccttcttgttatttgctgtttctaatgtggcttcaaaaatg

SEQ ID NO: 385 - DNA, 200 bp, Amaranthus palmeri
catttttgaagccacattagaaacagcaaataacaagaaggaaaaattaaaaaaaaaatctaataggtctatttgcaaaaaactgcctaatgtagttttctttttttgtaaaaaactacataatataatatatttctttgcaaatgactaccacttaatggaaaacgttagttgatcgtttaagggtttgaccaatttga

SEQ ID NO: 386 - DNA, 200 bp, Amaranthus palmeri
tgtttctaatgtggcttcaaaaatgaagtttggtaaccaaacttttcaaatttgaagtgagggttgggaagccttttggtgtcccttctattaagagttggggcctcacaatcactagataacgtgcctttctctcatgccttacctttctaattcttagaatagaaaaaagacggtgaattttttatacgctgtatgat

SEQ ID NO: 387 - DNA, 200 bp, Amaranthus palmeri
atcatacagcgtataaaaaattcaccgtcttttttctattctaagaattagaaaggtaaggcatgagagaaaggcacgttatctagtgattgtgaggccccaactcttaatagaagggacaccaaaaggcttcccaaccctcacttcaaatttgaaaagtttggttaccaaacttcatttttgaagccacattagaaaca

SEQ ID NO: 388 - DNA, 200 bp, Amaranthus palmeri
gtgaattttttatacgctgtatgattacattttttgaaatctctccgatcatcttgatcatgggatggaattgttcgtgcacatgttttttaagaatggaatctaagcatagtgtattagagagaatgagtgaaagttagtggaaagaaaaattgagttggagaataaaataaaaaacaagtgggtaatagaaataagtg

SEQ ID NO: 389 - DNA, 200 bp, Amaranthus palmeri
cacttatttctattacccacttgttttttattttattctccaactcaatttttctttccactaactttcactcattctctctaatacactatgcttagattccattcttaaaaaacatgtgcacgaacaattccatcccatgatcaagatgatcggagagatttcaaaaaatgtaatcatacagcgtataaaaaattcac

SEQ ID NO: 390 - DNA, 200 bp, Amaranthus palmeri
aacaagtgggtaatagaaataagtggttacgatgaagagggtgtataaatttgtagataagattaaaaggggtgggagtaccattgttataaaagaaaagagtgcaaaatccgttggacgaatttaaataaaaagtggtgtaaaatgaaaggaacgacaagaatatgattttcccagctataacactgtcacaaatgtaa

SEQ ID NO: 391 - DNA, 200 bp, Amaranthus palmeri
ttacatttgtgacagtgttatagctgggaaaatcatattcttgtcgttcctttcattttacaccactttttatttaaattcgtccaacggattttgcactcttttcttttataacaatggtactcccaccccttttaatcttatctacaaatttatacaccctcttcatcgtaaccacttatttctattacccacttgtt

SEQ ID NO: 392 - DNA, 200 bp, Amaranthus palmeri
tcagatatgtcttcataaagtattcaagtttgagcatgaaaatccacatgtacatgacatgagtatgcaaatgcaagtaatacaaacacataggcaaaagagatgatgtaatcactattcggtaatcgctcgcgcacaaatagtagctcactatatgaatgagatgagaaaatttcaattgttgtaaaggcgagttcctt

SEQ ID NO: 393 - DNA, 200 bp, Amaranthus palmeri
aaggaactcgcctttacaacaattgaaattttctcatctcattcatatagtgagctactatttgtgcgcgagcgattaccgaatagtgattacatcatctcttttgcctatgtgtttgtattacttgcatttgcatactcatgtcatgtacatgtggattttcatgctcaaacttgaatactttatgaagacatatctga

SEQ ID NO: 394 - DNA, 200 bp, Amaranthus palmeri
caattgttgtaaaggcgagttccttatgttttagtccaacagtgttttgtaacctttgtgtaattttttatatgaagcacaagagcaggtctcaaataagtacaggagataaatgaaactagaaataaaagtgttcaatatacttggacatagtcacatagttaatgccaaaatccatctttctgataagttggggccac

SEQ ID NO: 395 - DNA, 200 bp, Amaranthus palmeri
gtggccccaacttatcagaaagatggattttggcattaactatgtgactatgtccaagtatattgaacacttttatttctagtttcatttatctcctgtacttatttgagacctgctcttgtgcttcatataaaaaattacacaaaggttacaaaacactgttggactaaaacataaggaactcgcctttacaacaattg

SEQ ID NO: 396 - DNA, 200 bp, Amaranthus palmeri
catctttctgataagttggggccacttatacactatactaacatgagcctggaaagaaatagccagcaggaccgcaggtatagattgttagctaggaaaaccacaaaaccatactccctccatattaaaatgacattaacaagtgattagtaatgtaataacctacttacatattctaacaagtgattaatttcaatagt

SEQ ID NO: 397 - DNA, 200 bp, Amaranthus palmeri
actattgaaattaatcacttgttagaatatgtaagtaggttattacattactaatcacttgttaatgtcattttaatatggagggagtatggttttgtggttttcctagctaacaatctatacctgcggtcctgctggctatttctttccaggctcatgttagtatagtgtataagtggccccaacttatcagaaagatg

SEQ ID NO: 398 - DNA, 200 bp, Amaranthus palmeri
ctaacaagtgattaatttcaatagtattccgacaaaatgtagctttaataattatcttccatctcatcaaatttgtttgggaaatttgtaacactgatcaatgactctagcacaaggaatagctaaaattatcatcatcatcatgatcatcttgactagtgtatcccactcataaggaaactatgatcagggtctggaaa

SEQ ID NO: 399 - DNA, 200 bp, Amaranthus palmeri
tttccagaccctgatcatagtttccttatgagtgggatacactagtcaagatgatcatgatgatgatgataattttagctattccttgtgctagagtcattgatcagtgttacaaatttcccaaacaaatttgatgagatggaagataattattaaagctacattttgtcggaatactattgaaattaatcacttgttag

SEQ ID NO: 400 - DNA, 200 bp, Amaranthus palmeri
ggaaactatgatcagggtctggaaagggaaggaaggcgacaaatcataccataaagggagtttagaggtaatgaatacctaaatcctgatcctaaaacaattgatcttccccattaccacgccaatatcaacccacaaagcatccggggaaagtcaaacaaagggaaaaatcacaattgaaatatcctagtttcaagttt

SEQ ID NO: 401 - DNA, 200 bp, Amaranthus palmeri
aaacttgaaactaggatatttcaattgtgatttttccctttgtttgactttccccggatgctttgtgggttgatattggcgtggtaatggggaagatcaattgttttaggatcaggatttaggtattcattacctctaaactccctttatggtatgatttgtcgccttccttccctttccagaccctgatcatagtttcc

SEQ ID NO: 402 - DNA, 200 bp, Amaranthus palmeri
attgaaatatcctagtttcaagtttcaaccaattgggtaccatttacccatgttcaagtgtagcaaaaaccctaatatagcatcttaatacagctccagtaaacattatgcagtcttaatctgaagctactataccaaaacgactaacatttaacaaatgccattccaccattaaaaaaaagggtgttttagcggtaatg

SEQ ID NO: 403 - DNA, 200 bp, Amaranthus palmeri
cattaccgctaaaacacccttttttttaatggtggaatggcatttgttaaatgttagtcgttttggtatagtagcttcagattaagactgcataatgtttactggagctgtattaagatgctatattagggtttttgctacacttgaacatgggtaaatggtacccaattggttgaaacttgaaactaggatatttcaat

SEQ ID NO: 404 - DNA, 200 bp, Amaranthus palmeri
aaaaaagggtgttttagcggtaatgagttgatcggtcaatgtcaatccgagtaagaaaaaattaacacaatgcaaacccatttgccatgtttcaacacacaaacacaaaacactgataattccacaaatctgatactacaagcagcacaacagtcaattgcaaacataaccaaaaaaagctaaataaacagcagaacctg

SEQ ID NO: 405 - DNA, 200 bp, Amaranthus palmeri
caggttctgctgtttatttagctttttttggttatgtttgcaattgactgttgtgctgcttgtagtatcagatttgtggaattatcagtgttttgtgtttgtgtgttgaaacatggcaaatgggtttgcattgtgttaattttttcttactcggattgacattgaccgatcaactcattaccgctaaaacaccctttttt

SEQ ID NO: 406 - DNA, 200 bp, Amaranthus palmeri
aaagctaaataaacagcagaacctgggatcggaaaagggtggtcggcgtcgtgaacaaactagagagagaaagatgaatatagagagataaaggagtgagaaagaaggaaggagagtaagcagaatgaaatgggtagtgtggagtgtggaataatggttgaaaatgaagtgtggctcttccatagaggatagggatgctg

SEQ ID NO: 407 - DNA, 200 bp, Amaranthus palmeri
cagcatccctatcctctatggaagagccacacttcattttcaaccattattccacactccacactacccatttcattctgcttactctccttccttctttctcactcctttatctctctatattcatctttctctctctagtttgttcacgacgccgaccacccttttccgatcccaggttctgctgtttatttagcttt

SEQ ID NO: 408 - DNA, 200 bp, Amaranthus palmeri
tcttccatagaggatagggatgctgaaattgagtggtgaataaacaatctgaacaagatttggagaatgcaaaagaatctctggactaaattaatggaaaatcaaattgtatgtaatgatttagatatttaattagggttcttgtttgtgtctactcattctgtcactcacatgcatgctcattgtttgtatcaatctaa

SEQ ID NO: 409 - DNA, 200 bp, Amaranthus palmeri
ttagattgatacaaacaatgagcatgcatgtgagtgacagaatgagtagacacaaacaagaaccctaattaaatatctaaatcattacatacaatttgattttccattaatttagtccagagattcttttgcattctccaaatcttgttcagattgtttattcaccactcaatttcagcatccctatcctctatggaaga

SEQ ID NO: 410 - DNA, 200 bp, Amaranthus palmeri
atgctcattgtttgtatcaatctaaagccaagcattgactttttgggaaagccaaatagagaaaacaatatcctaaaggggaaatggactcataaaacgtgattgttactcccacctacagatgttcattcgggtcatcgagttgatttagggtcaggtgtttcgggtaggttcaaaatcgggttttgtgttcacattga

SEQ ID NO: 411 - DNA, 200 bp, Amaranthus palmeri
tcaatgtgaacacaaaacccgattttgaacctacccgaaacacctgaccctaaatcaactcgatgacccgaatgaacatctgtaggtgggagtaacaatcacgttttatgagtccatttcccctttaggatattgttttctctatttggctttcccaaaaagtcaatgcttggctttagattgatacaaacaatgagcat

SEQ ID NO: 412 - DNA, 200 bp, Amaranthus palmeri
aaatcgggttttgtgttcacattgatttttacatgattttaaattcatattgacgtcgggtcaagtcggattagattattaactcgggtaaatatcggatcatcgggtctgttttgaacacctctagtattttccaagttttgttgtatcacacatgcttgttgtggatgacctaaaattctttactgctgaaacgggac

SEQ ID NO: 413 - DNA, 200 bp, Amaranthus palmeri
gtcccgtttcagcagtaaagaattttaggtcatccacaacaagcatgtgtgatacaacaaaacttggaaaatactagaggtgttcaaaacagacccgatgatccgatatttacccgagttaataatctaatccgacttgacccgacgtcaatatgaatttaaaatcatgtaaaaatcaatgtgaacacaaaacccgattt

SEQ ID NO: 414 - DNA, 200 bp, Amaranthus palmeri
aaattctttactgctgaaacgggacattctgtgttgcgttacatttggtttttagtagaatataagtttcggtgggttgttaaggcaaaaaacaagcagatgagaagaaatgtgtggctgagatgaatagagagatttttgcggatagaactaggaaagggcacgtgggttcatatccgtaagtaaaaagttagcatata

SEQ ID NO: 415 - DNA, 200 bp, Amaranthus palmeri
tatatgctaactttttacttacggatatgaacccacgtgccctttcctagttctatccgcaaaaatctctctattcatctcagccacacatttcttctcatctgcttgttttttgccttaacaacccaccgaaacttatattctactaaaaaccaaatgtaacgcaacacagaatgtcccgtttcagcagtaaagaattt

SEQ ID NO: 416 - DNA, 200 bp, Amaranthus palmeri
tccgtaagtaaaaagttagcatataactatagaacaccgaaaaatgaaaaatgtagcgaattgataagtgatcatatgcaatataaagttctggtgttttctgatatattcttttgtgactaaattgaacgggaaaccatcaaaaataatcgtctgtcaaggtattgaaaatcctaacttgggctatcggtgtaggtaac

SEQ ID NO: 417 - DNA, 200 bp, Amaranthus palmeri
gttacctacaccgatagcccaagttaggattttcaataccttgacagacgattatttttgatggtttcccgttcaatttagtcacaaaagaatatatcagaaaacaccagaactttatattgcatatgatcacttatcaattcgctacatttttcatttttcggtgttctatagttatatgctaactttttacttacgga

SEQ ID NO: 418 - DNA, 200 bp, Amaranthus palmeri
aacttgggctatcggtgtaggtaaccataagggtggactttcagtgggaaaagcgatggcctccggatgcaaggctgcggaacttgtaatatcctatctggactctcatttatatgtgaagatggatgagaagaccgtgtaattcttctctgggaacgtcccctgattttgcgtctgtatatccgatgatatgtcgttgg

SEQ ID NO: 419 - DNA, 200 bp, Amaranthus palmeri
ccaacgacatatcatcggatatacagacgcaaaatcaggggacgttcccagagaagaattacacggtcttctcatccatcttcacatataaatgagagtccagataggatattacaagttccgcagccttgcatccggaggccatcgcttttcccactgaaagtccacccttatggttacctacaccgatagcccaagtt

SEQ ID NO: 420 - DNA, 200 bp, Amaranthus palmeri
tgtatatccgatgatatgtcgttggattgatcacgattgtagtcacgtttaggagttgtgcagtgacttttctgcctaaagactggatctgttagaaacaaatagtctatagatagtttctttgctcatcaggttatctttcttacaccagttgtgtatacaaatgttgcatagcctaacctaaattctaaaatgccatt

SEQ ID NO: 421 - DNA, 200 bp, Amaranthus palmeri
aatggcattttagaatttaggttaggctatgcaacatttgtatacacaactggtgtaagaaagataacctgatgagcaaagaaactatctatagactatttgtttctaacagatccagtctttaggcagaaaagtcactgcacaactcctaaacgtgactacaatcgtgatcaatccaacgacatatcatcggatataca

SEQ ID NO: 422 - DNA, 200 bp, Amaranthus palmeri
ctaacctaaattctaaaatgccattcccttttatatagggtcatgttttttgcatttatgaatggtgaaattttagatcttcactgagaataaaggttttggcaatttcataatggtgcttattaggggtatttaaaaccggatattggcaattttcattgataatattgtaatggaaaaatgacgttaaatatcttttt

SEQ ID NO: 423 - DNA, 200 bp, Amaranthus palmeri
aaaaagatatttaacgtcatttttccattacaatattatcaatgaaaattgccaatatccggttttaaatacccctaataagcaccattatgaaattgccaaaacctttattctcagtgaagatctaaaatttcaccattcataaatgcaaaaaacatgaccctatataaaagggaatggcattttagaatttaggttag

SEQ ID NO: 424 - DNA, 200 bp, Amaranthus rudis
acactcaaaactattcaggaaaggaaaaataatcctccaccccctcgagacccgtccgtaatcaccattacttattgctttccatcaccttgaatcttaccttaatatacatgtatttaattgataatgtcacattgcctcatttgcagccgccttcctaaacctaagggccagactgttggatcctttaggaaagggct

SEQ ID NO: 425 - DNA, 200 bp, Amaranthus rudis
agccctttcctaaaggatccaacagtctggcccttaggtttaggaaggcggctgcaaatgaggcaatgtgacattatcaattaaatacatgtatattaaggtaagattcaaggtgatggaaagcaataagtaatggtgattacggacgggtctcgagggggtggaggattatttttcctttcctgaatagttttgagtgt

SEQ ID NO: 426 - DNA, 200 bp, Amaranthus rudis
ctgttggatcctttaggaaagggctcattatgttacctaccgccattgctgctaggtatcttttgactctcaaaccttatatatttctcatcttctccttctgccagtgccatactaatactagtatctttaccatatattttttatttttttaggcttggcagtaaagtcaaactatcgtggacactttctaatattga

SEQ ID NO: 427 - DNA, 200 bp, Amaranthus rudis
tcaatattagaaagtgtccacgatagtttgactttactgccaagcctaaaaaaataaaaaatatatggtaaagatactagtattagtatggcactggcagaaggagaagatgagaaatatataaggtttgagagtcaaaagatacctagcagcaatggcggtaggtaacataatgagccctttcctaaaggatccaacag

SEQ ID NO: 428 - DNA, 200 bp, Amaranthus rudis
tatcgtggacactttctaatattgataagtcgctcaatggagaatacaatctcacttatcaaacacccgatggaccggtttctgttaggaccaaagcggttgtcatgaccgtcccttcgtacattgcaagtagcttgcttcgtccgctctcagtgagtatcattctttccttcatttctattcttttaatgctatccaat

SEQ ID NO: 429 - DNA, 200 bp, Amaranthus rudis
attggatagcattaaaagaatagaaatgaaggaaagaatgatactcactgagagcggacgaagcaagctacttgcaatgtacgaagggacggtcatgacaaccgctttggtcctaacagaaaccggtccatcgggtgtttgataagtgagattgtattctccattgagcgacttatcaatattagaaagtgtccacgata

SEQ ID NO: 430 - DNA, 200 bp, Amaranthus rudis
agagagtgcgagagagatgagtgcgatggcgttatcgagcagcattctacaatgtccgccgcactccgacatctcgttccgcttttttgctcatacacgaacccaatcccccatcttcttcggaagaccacgaaaattatcatatatccattgttccacaagctcaagctcaactgccaattaccagaacaccattacga

SEQ ID NO: 431 - DNA, 200 bp, Amaranthus rudis
tcgtaatggtgttctggtaattggcagttgagcttgagcttgtggaacaatggatatatgataattttcgtggtcttccgaagaagatgggggattgggttcgtgtatgagcaaaaaagcggaacgagatgtcggagtgcggcggacattgtagaatgctgctcgataacgccatcgcactcatctctctcgcactctct

SEQ ID NO: 432 - DNA, 200 bp, Amaranthus rudis
gccaattaccagaacaccattacgagccaaggagaaggagataaagtattagattgtgtaattgttggagctggtatcagtggactttgcattgctcaggctctttctaccaaacacattcaatccaatctcaatttcattgtcactgaagctaaacatcgtgttggaggtaatatcactaccatggagtccgatggcta

SEQ ID NO: 433 - DNA, 200 bp, Amaranthus rudis
tagccatcggactccatggtagtgatattacctccaacacgatgtttagcttcagtgacaatgaaattgagattggattgaatgtgtttggtagaaagagcctgagcaatgcaaagtccactgataccagctccaacaattacacaatctaatactttatctccttctccttggctcgtaatggtgttctggtaattggc

SEQ ID NO: 434 - DNA, 200 bp, Amaranthus rudis
tcactaccatggagtccgatggctatatctgggaagagggtcctaatagtttccaaccctccgatcctgtgcttactatggcggtaaactgattcttctctctttctccaatttttgatcattctattcaattttccccttattgaatcaaaatcaaattccaggttgacagtggattaaaagacgatttggtcttggga

SEQ ID NO: 435 - DNA, 200 bp, Amaranthus rudis
tcccaagaccaaatcgtcttttaatccactgtcaacctggaatttgattttgattcaataaggggaaaattgaatagaatgatcaaaaattggagaaagagagaagaatcagtttaccgccatagtaagcacaggatcggagggttggaaactattaggaccctcttcccagatatagccatcggactccatggtagtga

SEQ ID NO: 436 - DNA, 200 bp, Amaranthus rudis
attaaaagacgatttggtcttgggagatcctaatgcccctcgtttcgtgctctggaatggtaaattaaggcctgttccttccaaacctacggaccttcccttttttgatctcatgagctttcctggtaagattagggctggtcttggtgcacttggtcttcgtcctcctcctcctcctccttcttatgaggaatctgttg

SEQ ID NO: 437 - DNA, 200 bp, Amaranthus rudis
caacagattcctcataagaaggaggaggaggaggaggacgaagaccaagtgcaccaagaccagccctaatcttaccaggaaagctcatgagatcaaaaaagggaaggtccgtaggtttggaaggaacaggccttaatttaccattccagagcacgaaacgaggggcattaggatctcccaagaccaaatcgtcttttaat

SEQ ID NO: 438 - DNA, 200 bp, Amaranthus rudis
cctccttcttatgaggaatctgttgaagaatttgtgcgccgtaatctcggcgatgaggtcttcgaacgcttgatcgaacccttttgttctggtacctaccctgtttaatttttcaattttcccccttttttctctactactactttattgattcttatccatgagtgtactatgggagttgacaataattgttcaggtgt

SEQ ID NO: 439 - DNA, 200 bp, Amaranthus rudis
acacctgaacaattattgtcaactcccatagtacactcatggataagaatcaataaagtagtagtagagaaaaaagggggaaaattgaaaaattaaacagggtaggtaccagaacaaaagggttcgatcaagcgttcgaagacctcatcgccgagattacggcgcacaaattcttcaacagattcctcataagaaggagg

SEQ ID NO: 440 - DNA, 200 bp, Amaranthus rudis
atggtaattcaatccattacccacctttcaccaaaccttgcattgccatcgccattgtcagtttccaccaagaactacccagtagctgtaatgggcaacatttctgagcgggaagaacccacttctgctaaaagggttgctgttgttggtgctggagttagtggacttgctgctgcatataagctaaaatcccatggttt

SEQ ID NO: 441 - DNA, 200 bp, Amaranthus rudis
aaaccatgggattttagcttatatgcagcagcaagtccactaactccagcaccaacaacagcaacccttttagcagaagtgggttcttcccgctcagaaatgttgcccattacagctactgggtagttcttggtggaaactgacaatggcgatggcaatgcaaggtttggtgaaaggtgggtaatggattgaattaccat

SEQ ID NO: 442 - DNA, 200 bp, Amaranthus rudis
catataagctaaaatcccatggtttgagtgtgacattgtttgaagctgattctagagctggaggcaaacttaaaactgttaaaaaagatggttttatttgggatgagggggcaaatactatgacagaaagtgaggcagaggtctcgagtttgatcgatgatcttgggcttcgtgagaagcaacagttgccaatttcacaa

SEQ ID NO: 443 - DNA, 200 bp, Amaranthus rudis
ttgtgaaattggcaactgttgcttctcacgaagcccaagatcatcgatcaaactcgagacctctgcctcactttctgtcatagtatttgccccctcatcccaaataaaaccatcttttttaacagttttaagtttgcctccagctctagaatcagcttcaaacaatgtcacactcaaaccatgggattttagcttatatg

SEQ ID NO: 444 - DNA, 200 bp, Amaranthus rudis
gaagcaacagttgccaatttcacaaaataaaagatacatagctagagacggtcttcctgtgctactaccttcaaatcccgctgcactactcacgagcaatatcctttcagcaaaatcaaagctgcaaattatgttggaaccatttctctggagaaaacacaatgctactgaactttctgatgagcatgttcaggaaagcg

SEQ ID NO: 445 - DNA, 200 bp, Amaranthus rudis
cgctttcctgaacatgctcatcagaaagttcagtagcattgtgttttctccagagaaatggttccaacataatttgcagctttgattttgctgaaaggatattgctcgtgagtagtgcagcgggatttgaaggtagtagcacaggaagaccgtctctagctatgtatcttttattttgtgaaattggcaactgttgcttc

SEQ ID NO: 446 - DNA, 200 bp, Amaranthus rudis
tctgatgagcatgttcaggaaagcgttggtgaattttttgagcgacattttgggaaagagtttgttgattatgttattgacccttttgttgcgggtacatgtggtggagatcctcaatcgctttccatgcaccatacatttccagaagtatggaatattgaaaaaaggtttggctctgtgtttgctggactaattcaatc

SEQ ID NO: 447 - DNA, 200 bp, Amaranthus rudis
gattgaattagtccagcaaacacagagccaaaccttttttcaatattccatacttctggaaatgtatggtgcatggaaagcgattgaggatctccaccacatgtacccgcaacaaaagggtcaataacataatcaacaaactctttcccaaaatgtcgctcaaaaaattcaccaacgctttcctgaacatgctcatcaga

SEQ ID NO: 448 - DNA, 200 bp, Amaranthus rudis
ctgtgtttgctggactaattcaatcaacattgttatctaagaaggaaaagggtggagaaaatgcttctattaagaagcctcgtgtacgtggttcattttcatttcaaggtggaatgcagacacttgttgacacaatgtgcaaacagcttggtgaagatgaactcaaactccagtgtgaggtgctgtccttgtcatataac

SEQ ID NO: 449 - DNA, 200 bp, Amaranthus rudis
gttatatgacaaggacagcacctcacactggagtttgagttcatcttcaccaagctgtttgcacattgtgtcaacaagtgtctgcattccaccttgaaatgaaaatgaaccacgtacacgaggcttcttaatagaagcattttctccacccttttccttcttagataacaatgttgattgaattagtccagcaaacacag

SEQ ID NO: 450 - DNA, 200 bp, Amaranthus rudis
tgaggtgctgtccttgtcatataaccagaaggggatcccctcattagggaattggtcagtctcttctatgtcaaataataccagtgaagatcaatcttatgatgctgtggttgtcactgctccaattcgcaatgtcaaagaaatgaagattatgaaatttggaaatccattttcacttgactttattccagaggtgacgt

SEQ ID NO: 451 - DNA, 200 bp, Amaranthus rudis
acgtcacctctggaataaagtcaagtgaaaatggatttccaaatttcataatcttcatttctttgacattgcgaattggagcagtgacaaccacagcatcataagattgatcttcactggtattatttgacatagaagagactgaccaattccctaatgaggggatccccttctggttatatgacaaggacagcacctca

SEQ ID NO: 452 - DNA, 200 bp, Amaranthus rudis
cttgactttattccagaggtgacgtacgtacccctttccgttatgattactgcattcaaaaaggataaagtgaagagacctcttgagggcttcggagttcttatcccctctaaagagcaacataatggactgaagactcttggtactttattttcctccatgatgtttcctgatcgtgctccatctgacatgtgtctctt

SEQ ID NO: 453 - DNA, 200 bp, Amaranthus rudis
aagagacacatgtcagatggagcacgatcaggaaacatcatggaggaaaataaagtaccaagagtcttcagtccattatgttgctctttagaggggataagaactccgaagccctcaagaggtctcttcactttatcctttttgaatgcagtaatcataacggaaaggggtacgtacgtcacctctggaataaagtcaag

SEQ ID NO: 454 - DNA, 200 bp, Amaranthus rudis
gtgctccatctgacatgtgtctctttactacatttgtcggaggaagcagaaatagaaaacttgcaaacgcttcaacggatgaattgaagcaaatagtttcttctgaccttcagcagctgttgggcactgaggacgaaccttcatttgtcaatcatctcttttggagcaacgcattcccattgtatggacacaattacgat

SEQ ID NO: 455 - DNA, 200 bp, Amaranthus rudis
atcgtaattgtgtccatacaatgggaatgcgttgctccaaaagagatgattgacaaatgaaggttcgtcctcagtgcccaacagctgctgaaggtcagaagaaactatttgcttcaattcatccgttgaagcgtttgcaagttttctatttctgcttcctccgacaaatgtagtaaagagacacatgtcagatggagcac

SEQ ID NO: 456 - DNA, 200 bp, Amaranthus rudis
cccattgtatggacacaattacgattctgttttgagagccatagacaagatggaaaaggatcttcctggatttttttatgcaggtaaccataagggtggactttcagtgggaaaagcgatggcctccggatgcaaggctgcggaacttgtaatatcctatctggactctcatatatacgtgaagatggatgagaagaccg

SEQ ID NO: 457 - DNA, 200 bp, Amaranthus rudis
cggtcttctcatccatcttcacgtatatatgagagtccagataggatattacaagttccgcagccttgcatccggaggccatcgcttttcccactgaaagtccacccttatggttacctgcataaaaaaatccaggaagatccttttccatcttgtctatggctctcaaaacagaatcgtaattgtgtccatacaatggg

SEQ ID NO: 458 - DNA, 200 bp, Amaranthus rudis
attaagttttgatgtttttagctgcaataatttgttgatgaaaaagccactacttttttctcagctgcaaattatgttggaaccatttctctggagaaaacacaatgctactgaactttctgatgagcatgttcaggaaaggcaagtgccacatactattaagtgttagttgctgagaatatatttgaatctaagatgca

SEQ ID NO: 459 - DNA, 200 bp, Amaranthus rudis
tgcatcttagattcaaatatattctcagcaactaacacttaatagtatgtggcacttgcctttcctgaacatgctcatcagaaagttcagtagcattgtgttttctccagagaaatggttccaacataatttgcagctgagaaaaaagtagtggctttttcatcaacaaattattgcagctaaaaacatcaaaacttaat

SEQ ID NO: 460 - DNA, 200 bp, Amaranthus rudis
agaatatatttgaatctaagatgcacgaagaccactggtgcccttgctctatcaattctgatggaaaggattatcgctgaatttaccttctactaaaacatcgataaaatacttcattattagcatcaaaagattccctccatccttctggttttgctagacttgccttatgaaggtgttcaaggagtagtttgctaccc

SEQ ID NO: 461 - DNA, 200 bp, Amaranthus rudis
gggtagcaaactactccttgaacaccttcataaggcaagtctagcaaaaccagaaggatggagggaatcttttgatgctaataatgaagtattttatcgatgttttagtagaaggtaaattcagcgataatcctttccatcagaattgatagagcaagggcaccagtggtcttcgtgcatcttagattcaaatatattct

SEQ ID NO: 462 - DNA, 200 bp, Amaranthus rudis
gtgttcaaggagtagtttgctacccttcaagatagggtagtggttgccgtctctcataatttcagtcactcgttttcctctcctaattcaagccataatttttatggttcctccacacaacacttgctaaatttgaaaagtagcaaagaggaagtgagcaaaatcagcaggagtaggactgatgagtaagagcttgatta

SEQ ID NO: 463 - DNA, 200 bp, Amaranthus rudis
taatcaagctcttactcatcagtcctactcctgctgattttgctcacttcctctttgctacttttcaaatttagcaagtgttgtgtggaggaaccataaaaattatggcttgaattaggagaggaaaacgagtgactgaaattatgagagacggcaaccactaccctatcttgaagggtagcaaactactccttgaacac

SEQ ID NO: 464 - DNA, 200 bp, Amaranthus rudis
ggactgatgagtaagagcttgattaagtgtagaggattttcttttgtgttgaatatgaatgcatcatgcatgactgtagaattgacataatgatttgtctgcagcgttggtgaattttttgagcgacattttgggaaagaggtattgttgccaattgccatgctctattcattccggtgaattaacaaatgttgtgcttc

SEQ ID NO: 465 - DNA, 200 bp, Amaranthus rudis
gaagcacaacatttgttaattcaccggaatgaatagagcatggcaattggcaacaatacctctttcccaaaatgtcgctcaaaaaattcaccaacgctgcagacaaatcattatgtcaattctacagtcatgcatgatgcattcatattcaacacaaaagaaaatcctctacacttaatcaagctcttactcatcagtcc

SEQ ID NO: 466 - DNA, 200 bp, Amaranthus rudis
ggtgaattaacaaatgttgtgcttctgcttactattgcttataattattgtttgttgcagtttgttgattatgttattgacccttttgttgcgggtacatgtggtggagatcctcaatcgctttccgtgagttaaatactgtgcttgcttttttttttttcaacattttctggaggctgtaaataaattatactcctttc

SEQ ID NO: 467 - DNA, 200 bp, Amaranthus rudis
gaaaggagtataatttatttacagcctccagaaaatgttgaaaaaaaaaaaagcaagcacagtatttaactcacggaaagcgattgaggatctccaccacatgtacccgcaacaaaagggtcaataacataatcaacaaactgcaacaaacaataattataagcaatagtaagcagaagcacaacatttgttaattcacc

SEQ ID NO: 468 - DNA, 200 bp, Amaranthus rudis
gctgtaaataaattatactcctttctattctaatcaaatatcctatttccccttttggcatattcaaatttagttaaatattgtgtaaattatttacacaattgccattaaattttcacttttcccttactcactcttctcatgtgtcccttcccccttttcttaaaattggtgcattatcaaataggacatttgatttg

SEQ ID NO: 469 - DNA, 200 bp, Amaranthus rudis
caaatcaaatgtcctatttgataatgcaccaattttaagaaaagggggaagggacacatgagaagagtgagtaagggaaaagtgaaaatttaatggcaattgtgtaaataatttacacaatatttaactaaatttgaatatgccaaaaggggaaataggatatttgattagaatagaaaggagtataatttatttacagc

SEQ ID NO: 470 - DNA, 200 bp, Amaranthus rudis
attatcaaataggacatttgatttgaataggcgggagtttccaattgtgcttccaaaggtagcttgtcactttttctttttctttaaattttgtaccatgccatgcattttgaacctcaactcatttcgccataaaggaatattatgtttgagaagaacgaggatactattatcttatagataacatataggtttcatta

SEQ ID NO: 471 - DNA, 200 bp, Amaranthus rudis
taatgaaacctatatgttatctataagataatagtatcctcgttcttctcaaacataatattcctttatggcgaaatgagttgaggttcaaaatgcatggcatggtacaaaatttaaagaaaaagaaaaagtgacaagctacctttggaagcacaattggaaactcccgcctattcaaatcaaatgtcctatttgataat

SEQ ID NO: 472 - DNA, 200 bp, Amaranthus rudis
tatagataacatataggtttcattatcaatgattgtttgattttcaactcttcttttcctttcatgctcatattgatgttatttctatttgttatgaattatgtccattgtgttaatgtctttctttattgtagatgcaccatacatttccagaagtatggaatattgaaaaaaggtatgaaccttaaagctttaatttt

SEQ ID NO: 473 - DNA, 200 bp, Amaranthus rudis
aaaattaaagctttaaggttcataccttttttcaatattccatacttctggaaatgtatggtgcatctacaataaagaaagacattaacacaatggacataattcataacaaatagaaataacatcaatatgagcatgaaaggaaaagaagagttgaaaatcaaacaatcattgataatgaaacctatatgttatctata

SEQ ID NO: 474 - DNA, 200 bp, Amaranthus rudis
gtatgaaccttaaagctttaattttcttcgaacttaatgtttcttaattgattcttttggatcaatttccataagaatggaaatttaaaaaagggtatgaaccttaaagatttcttcgaacttatatgttttgtaattcatgcttttagatgctgcaccattttatctatgtgtcttaagtttgttgtaatcatttgtag

SEQ ID NO: 475 - DNA, 200 bp, Amaranthus rudis
ctacaaatgattacaacaaacttaagacacatagataaaatggtgcagcatctaaaagcatgaattacaaaacatataagttcgaagaaatctttaaggttcatacccttttttaaatttccattcttatggaaattgatccaaaagaatcaattaagaaacattaagttcgaagaaaattaaagctttaaggttcatac

SEQ ID NO: 476 - DNA, 200 bp, Amaranthus rudis
ttaagtttgttgtaatcatttgtagaccaaaagaatgaatggtctggtttgaaatggttcatcgtgcaaaaatgcgattttgcttgtgattgaggtaacattcaaggtggtgtgtttgtcgtactgtcaaatgtcttcctataccatgtgatatatatataagcctaaaatgatatattgtacacctttaggatgtggat

SEQ ID NO: 477 - DNA, 200 bp, Amaranthus rudis
atccacatcctaaaggtgtacaatatatcattttaggcttatatatatatcacatggtataggaagacatttgacagtacgacaaacacaccaccttgaatgttacctcaatcacaagcaaaatcgcatttttgcacgatgaaccatttcaaaccagaccattcattcttttggtctacaaatgattacaacaaacttaa

SEQ ID NO: 478 - DNA, 200 bp, Amaranthus rudis
tattgtacacctttaggatgtggatagcaggggttcagtacatatgaaaaatccttgcaatttgatctgtacgatcaatgtgattttgccttttgccttttgccttttgttatatgatgatgattccatgtgaaattttgggatttagaaaattcacttgtttaagaacatttgaatcaaactttcaccaatttcaacca

SEQ ID NO: 479 - DNA, 200 bp, Amaranthus rudis
tggttgaaattggtgaaagtttgattcaaatgttcttaaacaagtgaattttctaaatcccaaaatttcacatggaatcatcatcatataacaaaaggcaaaaggcaaaaggcaaaatcacattgatcgtacagatcaaattgcaaggatttttcatatgtactgaacccctgctatccacatcctaaaggtgtacaata

SEQ ID NO: 480 - DNA, 200 bp, Amaranthus rudis
atcaaactttcaccaatttcaaccacatttaattgcggcaaagccgaactttaaaagtcactcccaatctttgagatatccaaactccaaaacttctattagctttcatgttttcaccaagtaaagttggtgcgactccttaccattttctttattatgcatttcgttgatgtataatagtatagattggtgctctcttt

SEQ ID NO: 481 - DNA, 200 bp, Amaranthus rudis
aaagagagcaccaatctatactattatacatcaacgaaatgcataataaagaaaatggtaaggagtcgcaccaactttacttggtgaaaacatgaaagctaatagaagttttggagtttggatatctcaaagattgggagtgacttttaaagttcggctttgccgcaattaaatgtggttgaaattggtgaaagtttgat

SEQ ID NO: 482 - DNA, 200 bp, Amaranthus rudis
aatagtatagattggtgctctctttgctctccttccaacatgcataacttctagttcttgtcgttttcttttcctccctatttttatttgacttgtagctatttttgttcactcttctcgcccaatccatagctaaagaaacttgatttcattgattttgtaactgatatgcaattcatttttgtttgcttttagttgtt

SEQ ID NO: 483 - DNA, 200 bp, Amaranthus rudis
aacaactaaaagcaaacaaaaatgaattgcatatcagttacaaaatcaatgaaatcaagtttctttagctatggattgggcgagaagagtgaacaaaaatagctacaagtcaaataaaaatagggaggaaaagaaaacgacaagaactagaagttatgcatgttggaaggagagcaaagagagcaccaatctatactatt

SEQ ID NO: 484 - DNA, 200 bp, Amaranthus rudis
tcatttttgtttgcttttagttgttgattcaaaaacaataatgctaaagccctaatcctaacatgtcgggttagctgttgaaacaatacttgaaattgctataaaaagggattttttttcgggtacttcagttgttgagattgatatggtcaagtataatttgttttaacacaatttgtaatgatttaatggcttagttt

SEQ ID NO: 485 - DNA, 200 bp, Amaranthus rudis
aaactaagccattaaatcattacaaattgtgttaaaacaaattatacttgaccatatcaatctcaacaactgaagtacccgaaaaaaaatccctttttatagcaatttcaagtattgtttcaacagctaacccgacatgttaggattagggctttagcattattgtttttgaatcaacaactaaaagcaaacaaaaatga

SEQ ID NO: 486 - DNA, 200 bp, Amaranthus rudis
ttgtaatgatttaatggcttagtttcatagctgtttgtattaataaaggaaggaggactatctgaaattgcaataggaaagagattttagttcggtatttggttgtttaaattgatatggccaagtaatgttcattttacacaattggtaatgttttattggctcaatagtgtttgtaagtatgcgactcaaatttaatc

SEQ ID NO: 487 - DNA, 200 bp, Amaranthus rudis
gattaaatttgagtcgcatacttacaaacactattgagccaataaaacattaccaattgtgtaaaatgaacattacttggccatatcaatttaaacaaccaaataccgaactaaaatctctttcctattgcaatttcagatagtcctccttcctttattaatacaaacagctatgaaactaagccattaaatcattacaa

SEQ ID NO: 488 - DNA, 200 bp, Amaranthus rudis
gtaagtatgcgactcaaatttaatcaagtataacttattgaaacataaataaatatccattaggtttggctctgtgtttgctggactaattcaatcaacattgttatctaagaaggaaaagggtggagaaaatgcttctattaagaagcctcgtgtacgtggttcattttcatttcaaggtggaatgcaggtataaactt

SEQ ID NO: 489 - DNA, 200 bp, Amaranthus rudis
aagtttatacctgcattccaccttgaaatgaaaatgaaccacgtacacgaggcttcttaatagaagcattttctccacccttttccttcttagataacaatgttgattgaattagtccagcaaacacagagccaaacctaatggatatttatttatgtttcaataagttatacttgattaaatttgagtcgcatacttac

SEQ ID NO: 490 - DNA, 200 bp, Amaranthus rudis
caaggtggaatgcaggtataaacttgtagccataatttcactttttataccttatacttccaaaatatattgatgcgtttttcttgctacaaagtacaaacacaaaagctttgggaataattctcaattttgtcaaatctactaaaaatattctattaggaatcaaggtttctattttagaatatatggatgaagacatg

SEQ ID NO: 491 - DNA, 200 bp, Amaranthus rudis
catgtcttcatccatatattctaaaatagaaaccttgattcctaatagaatatttttagtagatttgacaaaattgagaattattcccaaagcttttgtgtttgtactttgtagcaagaaaaacgcatcaatatattttggaagtataaggtataaaaagtgaaattatggctacaagtttatacctgcattccaccttg

SEQ ID NO: 492 - DNA, 200 bp, Amaranthus rudis
tttagaatatatggatgaagacatgtagaagtgtgaataaaaaaacctagatgtgaaaggtttttagtctattaaacaagaatattagaattcagagtcgtttcatcaataaaatattgttgaagaggagcaattacattctgcttcaagcaaaggcaatcttaagaggaccctaaaacttgaggaggtatgagaactta

SEQ ID NO: 493 - DNA, 200 bp, Amaranthus rudis
taagttctcatacctcctcaagttttagggtcctcttaagattgcctttgcttgaagcagaatgtaattgctcctcttcaacaatattttattgatgaaacgactctgaattctaatattcttgtttaatagactaaaaacctttcacatctaggtttttttattcacacttctacatgtcttcatccatatattctaaa

SEQ ID NO: 494 - DNA, 200 bp, Amaranthus rudis
aaacttgaggaggtatgagaacttagaggccaaagaaattaaatttgatgaagagatttggtgagataccttgcttacaaaaatgattaattttccccttagacacctcaaattatgacatttataagttctccatgcgtattcgacaagatgttacatcctatattctaaattaagtatgaaatttgtatatgtgtaag

SEQ ID NO: 495 - DNA, 200 bp, Amaranthus rudis
cttacacatatacaaatttcatacttaatttagaatataggatgtaacatcttgtcgaatacgcatggagaacttataaatgtcataatttgaggtgtctaaggggaaaattaatcatttttgtaagcaaggtatctcaccaaatctcttcatcaaatttaatttctttggcctctaagttctcatacctcctcaagttt

SEQ ID NO: 496 - DNA, 200 bp, Amaranthus rudis
agtatgaaatttgtatatgtgtaagaaagaaaagttagtcccttgaattccatgtctacgacctcaaagtgttcataccattgaaattagcgagcttacgattgttaagaaaggatcaacttgtcatcattgatcattgatgaagtgtgtaatagacatactaggtgaaattcaaaagggatctactcagtctttgagtt

SEQ ID NO: 497 - DNA, 200 bp, Amaranthus rudis
aactcaaagactgagtagatcccttttgaatttcacctagtatgtctattacacacttcatcaatgatcaatgatgacaagttgatcctttcttaacaatcgtaagctcgctaatttcaatggtatgaacactttgaggtcgtagacatggaattcaagggactaacttttctttcttacacatatacaaatttcatact

SEQ ID NO: 498 - DNA, 200 bp, Amaranthus rudis
aagggatctactcagtctttgagtttaccgtttgcttctagtattttgctatttataggcactatcaaagggttcaatattgttttttctgaacattgttgccgaattgtgaagggagaatgatggtagatttctcttatttttatgagaaaattctctttataaagagttcgatagctcaaaaatgaaagcttattgcc

SEQ ID NO: 499 - DNA, 200 bp, Amaranthus rudis
ggcaataagctttcatttttgagctatcgaactctttataaagagaattttctcataaaaataagagaaatctaccatcattctcccttcacaattcggcaacaatgttcagaaaaaacaatattgaaccctttgatagtgcctataaatagcaaaatactagaagcaaacggtaaactcaaagactgagtagatccctt

SEQ ID NO: 500 - DNA, 200 bp, Amaranthus rudis
agctcaaaaatgaaagcttattgccaaaagtggatggggtagatgaaggagaaatgcaatcaattttggtaggcttgactttgagtaaagaatttgtggaataaggtagaaaaataggatttggctgcatgatattgaaaccttttgctacttttctttttgttttggttgcaatgcacagaaaggcaggacggtaaagt

SEQ ID NO: 501 - DNA, 200 bp, Amaranthus rudis
actttaccgtcctgcctttctgtgcattgcaaccaaaacaaaaagaaaagtagcaaaaggtttcaatatcatgcagccaaatcctatttttctaccttattccacaaattctttactcaaagtcaagcctaccaaaattgattgcatttctccttcatctaccccatccacttttggcaataagctttcatttttgagct

SEQ ID NO: 502 - DNA, 200 bp, Amaranthus rudis
gcacagaaaggcaggacggtaaagtgtgataaaatggatgggaaaaattgctagaatagaatagaagaaaaataatggcaggatgtatcctttgttaccctagtttcgacaactgtgttacgtcggtattatcggtggcttggactgagtcatcatagaaattcttctctgatatagtttagatgaaatttttaaaattt

SEQ ID NO: 503 - DNA, 200 bp, Amaranthus rudis
aaattttaaaaatttcatctaaactatatcagagaagaatttctatgatgactcagtccaagccaccgataataccgacgtaacacagttgtcgaaactagggtaacaaaggatacatcctgccattatttttcttctattctattctagcaatttttcccatccattttatcacactttaccgtcctgcctttctgtgc

SEQ ID NO: 504 - DNA, 200 bp, Amaranthus rudis
agtttagatgaaatttttaaaatttaagcaggcctgaattttgataaagatagcatgatctaaagaaggcagctctaataaatcaacataaaatttgatattaagtagtctctgtctaggcctgctttccgagctagtatattaactgagtacatgttattagagcaatagcataggagtcatgtttttgcatactgatt

SEQ ID NO: 505 - DNA, 200 bp, Amaranthus rudis
aatcagtatgcaaaaacatgactcctatgctattgctctaataacatgtactcagttaatatactagctcggaaagcaggcctagacagagactacttaatatcaaattttatgttgatttattagagctgccttctttagatcatgctatctttatcaaaattcaggcctgcttaaattttaaaaatttcatctaaact

SEQ ID NO: 506 - DNA, 200 bp, Amaranthus rudis
ggagtcatgtttttgcatactgattagcatgtcaattttattccatttgctgagtactgtatgttctgcagacacttgttgacacaatgtgcaaacagcttggtgaagatgaactcaaactccagtgtgaggtgctgtccttgtcatataaccagaaggggatcccctcattagggaattggtcagtctcttctatgtca

SEQ ID NO: 507 - DNA, 200 bp, Amaranthus rudis
tgacatagaagagactgaccaattccctaatgaggggatccccttctggttatatgacaaggacagcacctcacactggagtttgagttcatcttcaccaagctgtttgcacattgtgtcaacaagtgtctgcagaacatacagtactcagcaaatggaataaaattgacatgctaatcagtatgcaaaaacatgactcc

SEQ ID NO: 508 - DNA, 200 bp, Amaranthus rudis
gaattggtcagtctcttctatgtcaaataataccagtgaagatcaatcttatgatgctgtggttgtcactgtgagtttttgtctacttttgtctctatgagcatgcaattcctttcacagccgttgagttagcaattatattccagtttgaaacttaaagttttttgggggaatttttctagcattcaagtcaatcaagg

SEQ ID NO: 509 - DNA, 200 bp, Amaranthus rudis
ccttgattgacttgaatgctagaaaaattcccccaaaaaactttaagtttcaaactggaatataattgctaactcaacggctgtgaaaggaattgcatgctcatagagacaaaagtagacaaaaactcacagtgacaaccacagcatcataagattgatcttcactggtattatttgacatagaagagactgaccaattc

SEQ ID NO: 510 - DNA, 200 bp, Amaranthus rudis
tttctagcattcaagtcaatcaaggcttatttggaactcaaagctttatctatgttatatgaaactacaataaaatgatttctaaaaaattaattgcgaatagcggagattcaattagggtgtataattgatccacatcaaatagcatgcattctacatgttagtcacttgtggcttctctagtcctctgtctccagaaa

SEQ ID NO: 511 - DNA, 200 bp, Amaranthus rudis
tttctggagacagaggactagagaagccacaagtgactaacatgtagaatgcatgctatttgatgtggatcaattatacaccctaattgaatctccgctattcgcaattaattttttagaaatcattttattgtagtttcatataacatagataaagctttgagttccaaataagccttgattgacttgaatgctagaaa

SEQ ID NO: 512 - DNA, 200 bp, Amaranthus rudis
ttctctagtcctctgtctccagaaaaagcctgcatacaaaggctcatgaagactagtatgctatatactttccgaaatgtcagcattaagtaacttgtgttgaggaaatatgtaaatcgtaccctgttaccctctttttaaagagtgattttttttttaattgaatgtggttatagctatctggtttgatgaagatttac

SEQ ID NO: 513 - DNA, 200 bp, Amaranthus rudis
gtaaatcttcatcaaaccagatagctataaccacattcaattaaaaaaaaaatcactctttaaaaagagggtaacagggtacgatttacatatttcctcaacacaagttacttaatgctgacatttcggaaagtatatagcatactagtcttcatgagcctttgtatgcaggctttttctggagacagaggactagagaa

SEQ ID NO: 514 - DNA, 200 bp, Amaranthus rudis
gctatctggtttgatgaagatttaccattcttaatgaagcaaaaaattttaagttcacaagtttcaattatattaggcatttaggctgctatacagtgaattggctcgataaattttgcgcatgtcttatttatgtgaattgtagataacgtttgctacaaagggtcaatcaagaacaaccttttcatttttgtaaggat

SEQ ID NO: 515 - DNA, 200 bp, Amaranthus rudis
atccttacaaaaatgaaaaggttgttcttgattgaccctttgtagcaaacgttatctacaattcacataaataagacatgcgcaaaatttatcgagccaattcactgtatagcagcctaaatgcctaatataattgaaacttgtgaacttaaaattttttgcttcattaagaatggtaaatcttcatcaaaccagatagc

SEQ ID NO: 516 - DNA, 200 bp, Amaranthus rudis
acaaccttttcatttttgtaaggataactcctaaattctgcctaggttggaggatatgtggaagtcacttaatggcaataggactgaaatattgttgaatatggttatctagtaccaattcacacttgtatacatgagtacatgtctaatgctctttgttgtgatttacttaaacaagaattatgttcattagcaggctt

SEQ ID NO: 517 - DNA, 200 bp, Amaranthus rudis
aagcctgctaatgaacataattcttgtttaagtaaatcacaacaaagagcattagacatgtactcatgtatacaagtgtgaattggtactagataaccatattcaacaatatttcagtcctattgccattaagtgacttccacatatcctccaacctaggcagaatttaggagttatccttacaaaaatgaaaaggttgt

SEQ ID NO: 518 - DNA, 200 bp, Amaranthus rudis
aagaattatgttcattagcaggctttcatgctctctgtacagcaccttatctttcctttaccacgatactatttgtcttgtttaattatacatatatcataaatgtttcgacattcggtctaaaatattttggatgggtgtatactgtttaatgcaacaatatgtaaaatagatacataaagaaaagtaaaaggaataat

SEQ ID NO: 519 - DNA, 200 bp, Amaranthus rudis
attattccttttacttttctttatgtatctattttacatattgttgcattaaacagtatacacccatccaaaatattttagaccgaatgtcgaaacatttatgatatatgtataattaaacaagacaaatagtatcgtggtaaaggaaagataaggtgctgtacagagagcatgaaagcctgctaatgaacataattctt

SEQ ID NO: 520 - DNA, 200 bp, Amaranthus rudis
cataaagaaaagtaaaaggaataatgaattacaaaaaatacgatgaaaattgaaaatggatgttgtatttcaaaaggaggttaaaggagtgatttgcttccaaagtagaaatcattccgagttcgtagattgttttaagaataccgagtgtagtatggattatggtggacaaaattttctataatattttttcataaaca

SEQ ID NO: 521 - DNA, 200 bp, Amaranthus rudis
tgtttatgaaaaaatattatagaaaattttgtccaccataatccatactacactcggtattcttaaaacaatctacgaactcggaatgatttctactttggaagcaaatcactcctttaacctccttttgaaatacaacatccattttcaattttcatcgtattttttgtaattcattattccttttacttttctttatg

SEQ ID NO: 522 - DNA, 200 bp, Amaranthus rudis
gagagagtgcgagagagatgagtgcgatggcgttatcgagcagcattctacaatgtccgccgcactccgacatctcgttccgcttttttgctcatacacgaacccaatcccccatcttcttcggaagaccacgaaaattatcatatatccattgttccacaagctcaagctcaactgccaattaccagaacaccattacg

SEQ ID NO: 523 - DNA, 200 bp, Amaranthus rudis
cgtaatggtgttctggtaattggcagttgagcttgagcttgtggaacaatggatatatgataattttcgtggtcttccgaagaagatgggggattgggttcgtgtatgagcaaaaaagcggaacgagatgtcggagtgcggcggacattgtagaatgctgctcgataacgccatcgcactcatctctctcgcactctctc

SEQ ID NO: 524 - DNA, 200 bp, Amaranthus rudis
tgccaattaccagaacaccattacgagccaaggagaaggagataaagtattagattgtgtaattgttggagctggtatcagtggactttgcattgctcaggctctttctaccaaacacattcaatccaatctcaatttcattgtcactgaagctaaacatcgtgttggaggtaatatcactaccatggagtccgatggct

SEQ ID NO: 525 - DNA, 200 bp, Amaranthus rudis
agccatcggactccatggtagtgatattacctccaacacgatgtttagcttcagtgacaatgaaattgagattggattgaatgtgtttggtagaaagagcctgagcaatgcaaagtccactgataccagctccaacaattacacaatctaatactttatctccttctccttggctcgtaatggtgttctggtaattggca

SEQ ID NO: 526 - DNA, 200 bp, Amaranthus rudis
atcactaccatggagtccgatggctatatctgggaagagggtcctaatagtttccaaccctccgatcctgtgcttactatggcggttgacagtggattgaaagacgatttggtcttgggagatcctaatgcccctcgtttcgtgctctggaatggtaaattaaggcctgttccttccaaacctacggaccttcccttttt

SEQ ID NO: 527 - DNA, 200 bp, Amaranthus rudis
aaaaagggaaggtccgtaggtttggaaggaacaggccttaatttaccattccagagcacgaaacgaggggcattaggatctcccaagaccaaatcgtctttcaatccactgtcaaccgccatagtaagcacaggatcggagggttggaaactattaggaccctcttcccagatatagccatcggactccatggtagtgat

SEQ ID NO: 528 - DNA, 200 bp, Amaranthus rudis
ccaaacctacggaccttcccttttttgatctcatgagctttcctggtaagattagggctggtcttggtgcacttggtcttcgtcctcctcctcctcctccttcttatgaggaatctgttgaagaatttgtgcgccgtaatctcggcgatgaggtcttcgaacgcttgatcgaacccttttgttctggtgtctatgctggt

SEQ ID NO: 529 - DNA, 200 bp, Amaranthus rudis
accagcatagacaccagaacaaaagggttcgatcaagcgttcgaagacctcatcgccgagattacggcgcacaaattcttcaacagattcctcataagaaggaggaggaggaggaggacgaagaccaagtgcaccaagaccagccctaatcttaccaggaaagctcatgagatcaaaaaagggaaggtccgtaggtttgg

SEQ ID NO: 530 - DNA, 200 bp, Amaranthus rudis
cttttgttctggtgtctatgctggtgatcctgcaaagttgagtatgaaagctgcatttggaaaggtctggaccttagagcaaaagggtggtagtatcatcgccggtacactcaaaactattcaggaaaggaagaataatcctccaccccctcgagacccccgccttcctaaacctaagggccagactgttggatccttta

SEQ ID NO: 531 - DNA, 200 bp, Amaranthus rudis
taaaggatccaacagtctggcccttaggtttaggaaggcgggggtctcgagggggtggaggattattcttcctttcctgaatagttttgagtgtaccggcgatgatactaccacccttttgctctaaggtccagacctttccaaatgcagctttcatactcaactttgcaggatcaccagcatagacaccagaacaaaag

SEQ ID NO: 532 - DNA, 200 bp, Amaranthus rudis
aagggccagactgttggatcctttaggaaagggctcattatgttacctaccgccattgctgctaggcttggcagtaaagtcaaactatcgtggacactttctaatattgataagtcgctcaatggtgaatacattctcacttatcaaacacccgatggaccggtttctgttaggaccaaagcggttgtcatgactgtccc

SEQ ID NO: 533 - DNA, 200 bp, Amaranthus rudis
gggacagtcatgacaaccgctttggtcctaacagaaaccggtccatcgggtgtttgataagtgagaatgtattcaccattgagcgacttatcaatattagaaagtgtccacgatagtttgactttactgccaagcctagcagcaatggcggtaggtaacataatgagccctttcctaaaggatccaacagtctggccctt

SEQ ID NO: 534 - DNA, 200 bp, Amaranthus rudis
gcgagagagatgagtgcgatggcgttatcgagcagcattctacaatgtccgccgcactccgacatctcgttccgcttttttgctcatacacgaacccaatcccccatcttcttcggaagaccacgaaaattatcatatatccattgttccacaagctcaagctcaactgccaattaccagaacaccattacgagccaagg

SEQ ID NO: 535 - DNA, 200 bp, Amaranthus rudis
ccttggctcgtaatggtgttctggtaattggcagttgagcttgagcttgtggaacaatggatatatgataattttcgtggtcttccgaagaagatgggggattgggttcgtgtatgagcaaaaaagcggaacgagatgtcggagtgcggcggacattgtagaatgctgctcgataacgccatcgcactcatctctctcgc

SEQ ID NO: 536 - DNA, 200 bp, Amaranthus rudis
accagaacaccattacgagccaaggagaaggagataaagtattagattgtgtaattgttggagctggtatcagtggactttgcattgctcaggctctttctaccaaacacattcaatccaatctcaatttcattgtcactgaagctaaacatcgtgttggaggtaatatcactaccatggagtccgatggctatatctgg

SEQ ID NO: 537 - DNA, 200 bp, Amaranthus rudis
ccagatatagccatcggactccatggtagtgatattacctccaacacgatgtttagcttcagtgacaatgaaattgagattggattgaatgtgtttggtagaaagagcctgagcaatgcaaagtccactgataccagctccaacaattacacaatctaatactttatctccttctccttggctcgtaatggtgttctggt

SEQ ID NO: 538 - DNA, 200 bp, Amaranthus rudis
catggagtccgatggctatatctgggaagagggtcctaatagtttccaaccctccgatcctgtgcttactatggcggttgacagtggattgaaagacgatttggtcttgggagatcctaatgcccctcgtttcgtgctctggaatggtaaattaaggcctgttccttccaaacctacggaccttcccttttttgatctca

SEQ ID NO: 539 - DNA, 200 bp, Amaranthus rudis
tgagatcaaaaaagggaaggtccgtaggtttggaaggaacaggccttaatttaccattccagagcacgaaacgaggggcattaggatctcccaagaccaaatcgtctttcaatccactgtcaaccgccatagtaagcacaggatcggagggttggaaactattaggaccctcttcccagatatagccatcggactccatg

SEQ ID NO: 540 - DNA, 200 bp, Amaranthus rudis
acggaccttcccttttttgatctcatgagctttcctggtaagattagggctggtcttggtgcacttggtcttcgtcctcctcctcctcctccttcttatgaggaatctgttgaagaatttgtgcgccgtaatctcggcgatgaggtcttcgaacgcttgatcgaacccttttgttctggtgtctatgctggtgatcctgc

SEQ ID NO: 541 - DNA, 200 bp, Amaranthus rudis
gcaggatcaccagcatagacaccagaacaaaagggttcgatcaagcgttcgaagacctcatcgccgagattacggcgcacaaattcttcaacagattcctcataagaaggaggaggaggaggaggacgaagaccaagtgcaccaagaccagccctaatcttaccaggaaagctcatgagatcaaaaaagggaaggtccgt

SEQ ID NO: 542 - DNA, 200 bp, Amaranthus rudis
ctggtgtctatgctggtgatcctgcaaagttgagtatgaaagctgcatttggaaaggtctggaccttagagcaaaagggtggtagtatcatagccggtacactcaaaactattcaggaaaggaaaaataatcctctaccccctcgagacccccgccttcctaaacctaagggccagactgttggatcctttaggaaaggg

SEQ ID NO: 543 - DNA, 200 bp, Amaranthus rudis
ccctttcctaaaggatccaacagtctggcccttaggtttaggaaggcgggggtctcgagggggtagaggattatttttcctttcctgaatagttttgagtgtaccggctatgatactaccacccttttgctctaaggtccagacctttccaaatgcagctttcatactcaactttgcaggatcaccagcatagacaccag

SEQ ID NO: 544 - DNA, 200 bp, Amaranthus rudis
gactgttggatcctttaggaaagggctcattatgttacctaccgccattgctgctaggcttggcagtaaagtcaaactatcgtggacactttctaatattgataagtcgctcaatggagaatacaatctcacttatcaaacacccgatggaccggtttctgttaggaccaaagcggttgtcatgaccgtcccttcgtaca

SEQ ID NO: 545 - DNA, 200 bp, Amaranthus rudis
tgtacgaagggacggtcatgacaaccgctttggtcctaacagaaaccggtccatcgggtgtttgataagtgagattgtattctccattgagcgacttatcaatattagaaagtgtccacgatagtttgactttactgccaagcctagcagcaatggcggtaggtaacataatgagccctttcctaaaggatccaacagtc

SEQ ID NO: 546 - DNA, 200 bp, Amaranthus rudis
gttgtcatgaccgtcccttcgtacattgcaagtagcttgcttcgtccgctctcagatgttgctgcagattctctttctaaattttactatccaccagtcgcagcagtgtccctttcttatcccaaagaagcaattagaccagaatgcttgattgatggagaactaaaaggattcgggcaattgcatccccgcagccaggg

SEQ ID NO: 547 - DNA, 200 bp, Amaranthus rudis
ccctggctgcggggatgcaattgcccgaatccttttagttctccatcaatcaagcattctggtctaattgcttctttgggataagaaagggacactgctgcgactggtggatagtaaaatttagaaagagaatctgcagcaacatctgagagcggacgaagcaagctacttgcaatgtacgaagggacggtcatgacaac

SEQ ID NO: 548 - DNA, 200 bp, Amaranthus rudis
ggcaattgcatccccgcagccagggtgtggaaaccttgggtacaatttatagttcatctcttttccctggtcgagcaccacccggtaggaccttgatcttgagctacattggaggtgctacaaatcttggcatattacaaaagagtgaagatgaacttgcggagacagttgataaggatctcagaaaaattctgataaat

SEQ ID NO: 549 - DNA, 200 bp, Amaranthus rudis
atttatcagaatttttctgagatccttatcaactgtctccgcaagttcatcttcactcttttgtaatatgccaagatttgtagcacctccaatgtagctcaagatcaaggtcctaccgggtggtgctcgaccagggaaaagagatgaactataaattgtacccaaggtttccacaccctggctgcggggatgcaattgcc

SEQ ID NO: 550 - DNA, 200 bp, Amaranthus rudis
ggatctcagaaaaattctgataaatccaaatgcgaaaggcagccgtgttctgggagtgagagtatggccaaaggcaatcccccaatttttagttggtcactttgatgtgctagatgctgcaaaagctggtttggcaaatgctgggctaaaggggttgtttcttggtggtaattatgtatcaggtgttgccttggggaggt

SEQ ID NO: 551 - DNA, 200 bp, Amaranthus rudis
acctccccaaggcaacacctgatacataattaccaccaagaaacaacccctttagcccagcatttgccaaaccagcttttgcagcatctagcacatcaaagtgaccaactaaaaattgggggattgcctttggccatactctcactcccagaacacggctgcctttcgcatttggatttatcagaatttttctgagatcc

SEQ ID NO: 552 - DNA, 200 bp, Amaranthus rudis
gtatcaggtgttgccttggggaggtgtatagagggtgcttatgactctgcttctgaggtagtggatttcctctcacagtacaaagataagtagtcaatagggctccagcatcttggttaagtaactttttgtagctgttgtaatttggaaagatgtaaaatagcccacactcaaacaagtttggaaagatgtaaaagcat

SEQ ID NO: 553 - DNA, 200 bp, Amaranthus rudis
atgcttttacatctttccaaacttgtttgagtgtgggctattttacatctttccaaattacaacagctacaaaaagttacttaaccaagatgctggagccctattgactacttatctttgtactgtgagaggaaatccactacctcagaagcagagtcataagcaccctctatacacctccccaaggcaacacctgatac

SEQ ID NO: 554 - DNA, 200 bp, Amaranthus rudis
ggccagggtgtggaaaccttgggaacaatttatagttcatctcttttccctggtcgagcaccacccggtaggaccttgatcttgagctacattggaggtgctacaaatcttggcatattacaaaagagtgaagatgaacttgcggagacagttgataaggatctcagaaaaattctgataaatccaaatgcgaaaggcag

SEQ ID NO: 555 - DNA, 200 bp, Amaranthus rudis
ctgcctttcgcatttggatttatcagaatttttctgagatccttatcaactgtctccgcaagttcatcttcactcttttgtaatatgccaagatttgtagcacctccaatgtagctcaagatcaaggtcctaccgggtggtgctcgaccagggaaaagagatgaactataaattgttcccaaggtttccacaccctggcc

SEQ ID NO: 556 - DNA, 200 bp, Amaranthus rudis
tgataaatccaaatgcgaaaggcagccgtgttctgggagtgagagtatggccaaaggcaatcccccaatttttagttggtcactttgatgtgctagatgctgcaaaagctggtttggcaaatgctgggctaaaggggttgtttcttggtggtaattatgtatcaggtgttgccttggggaggtgtatagagggtgcttat

SEQ ID NO: 557 - DNA, 200 bp, Amaranthus rudis
ataagcaccctctatacacctccccaaggcaacacctgatacataattaccaccaagaaacaacccctttagcccagcatttgccaaaccagcttttgcagcatctagcacatcaaagtgaccaactaaaaattgggggattgcctttggccatactctcactcccagaacacggctgcctttcgcatttggatttatca

SEQ ID NO: 558 - DNA, 200 bp, Amaranthus rudis
ggggaggtgtatagagggtgcttatgactctgcttctgaggtagtggatttcctctcacagtacaaagataagtagtcaatagggctccagcatcttggttaagtaactttttgtagctgttgtaatttggaaagatgtaaaatagcccacactcaaacaagtttggaaagatgtaaaagcatgagatacagtcggtgtt

SEQ ID NO: 559 - DNA, 200 bp, Amaranthus rudis
aacaccgactgtatctcatgcttttacatctttccaaacttgtttgagtgtgggctattttacatctttccaaattacaacagctacaaaaagttacttaaccaagatgctggagccctattgactacttatctttgtactgtgagaggaaatccactacctcagaagcagagtcataagcaccctctatacacctcccc

SEQ ID NO: 560 - DNA, 200 bp, Amaranthus rudis
gtcttgggagatcctaatgcccctcgtttcgtgctctggaatggtaaattaaggcctgttccttccaaacctacggaccttcccttttttgatctcatgagctttcctggtaagattagggctggtcttggtgcacttggtcttcgtcctcctcctcctcctccttcttatgaggaatctgttgaagaatttgtgcgccg

SEQ ID NO: 561 - DNA, 200 bp, Amaranthus rudis
cggcgcacaaattcttcaacagattcctcataagaaggaggaggaggaggaggacgaagaccaagtgcaccaagaccagccctaatcttaccaggaaagctcatgagatcaaaaaagggaaggtccgtaggtttggaaggaacaggccttaatttaccattccagagcacgaaacgaggggcattaggatctcccaagac

SEQ ID NO: 562 - DNA, 200 bp, Amaranthus rudis
ggtggtagtatcatagccggtacactcaaaactattcaggaaaggaaaaataatcctccaccccctcgagacccgtccgtaatcaccattacttattgctttccatcaccttgaatcttaccttaatatacatgtatttaattgataatgtcacattgcctcatttgcagccgccttcctaaacctaagggccagactgt

SEQ ID NO: 563 - DNA, 200 bp, Amaranthus rudis
acagtctggcccttaggtttaggaaggcggctgcaaatgaggcaatgtgacattatcaattaaatacatgtatattaaggtaagattcaaggtgatggaaagcaataagtaatggtgattacggacgggtctcgagggggtggaggattatttttcctttcctgaatagttttgagtgtaccggctatgatactaccacc

SEQ ID NO: 564 - DNA, 200 bp, Amaranthus rudis
ttgatttgaagataggataaccagagagagtgcgagagagatgagtgcgatggcgttatcgagcagcattctacaatgtccgccgcactccgacatctcgttccgcttttttgctcatacacgaacccaatcccccatcttcttcggaagaccacgaaaattatcatatatccattgttccacaagctcaagctcaactg

SEQ ID NO: 565 - DNA, 200 bp, Amaranthus rudis
cagttgagcttgagcttgtggaacaatggatatatgataattttcgtggtcttccgaagaagatgggggattgggttcgtgtatgagcaaaaaagcggaacgagatgtcggagtgcggcggacattgtagaatgctgctcgataacgccatcgcactcatctctctcgcactctctctggttatcctatcttcaaatcaa

SEQ ID NO: 566 - DNA, 200 bp, Amaranthus rudis
tgttccacaagctcaagctcaactgccaattaccagaacaccattacgagccaaggagaaggagataaagtattagattgtgtaattgttggagctggtatcagtggactttgcattgctcaggctctttctaccaaacacattcaatccaatctcaatttcattgtcactgaagctaaacatcgtgttggaggtaatat

SEQ ID NO: 567 - DNA, 200 bp, Amaranthus rudis
atattacctccaacacgatgtttagcttcagtgacaatgaaattgagattggattgaatgtgtttggtagaaagagcctgagcaatgcaaagtccactgataccagctccaacaattacacaatctaatactttatctccttctccttggctcgtaatggtgttctggtaattggcagttgagcttgagcttgtggaaca

SEQ ID NO: 568 - DNA, 200 bp, Amaranthus rudis
ttttaaccaatcctcaaaatttacaccatggagatgtctgcggataagaattagtaactgtagcagctgtaattgttgcatgcagttttatggtttgccttgcaattcaaacttgggatattgtttgccttgcaatttgtagtttagtgtttgcccttcactttgtattttagttatttttttcattgcaatttgctctt

SEQ ID NO: 569 - DNA, 200 bp, Amaranthus rudis
aagagcaaattgcaatgaaaaaaataactaaaatacaaagtgaagggcaaacactaaactacaaattgcaaggcaaacaatatcccaagtttgaattgcaaggcaaaccataaaactgcatgcaacaattacagctgctacagttactaattcttatccgcagacatctccatggtgtaaattttgaggattggttaaaa

SEQ ID NO: 570 - DNA, 200 bp, Amaranthus rudis
atttttttcattgcaatttgctctttgaagtataaaatggtgacctttcttgctcaggatgttgctgcagattctctttctaaattttactatccaccagtcgcagcagtgtccctttcttatcccaaagaagcaattagaccagaatgcttgatcgatggagaactaaaaggattcgggcaattgcatccccgcagcca

SEQ ID NO: 571 - DNA, 200 bp, Amaranthus rudis
tggctgcggggatgcaattgcccgaatccttttagttctccatcgatcaagcattctggtctaattgcttctttgggataagaaagggacactgctgcgactggtggatagtaaaatttagaaagagaatctgcagcaacatcctgagcaagaaaggtcaccattttatacttcaaagagcaaattgcaatgaaaaaaat

SEQ ID NO: 572 - DNA, 200 bp, Amaranthus rudis
tcgggcaattgcatccccgcagccagggtgtggaaaccttgggtatatgctcccattcaactatatctcaataattatgagtatttttctttctctggattattcaatttggtgacgttaaattttgactgtactcgacaggaacaatttatagttcatctcttttccctggtcgagcaccacccggtaggaccttgatc

SEQ ID NO: 573 - DNA, 200 bp, Amaranthus rudis
gatcaaggtcctaccgggtggtgctcgaccagggaaaagagatgaactataaattgttcctgtcgagtacagtcaaaatttaacgtcaccaaattgaataatccagagaaagaaaaatactcataattattgagatatagttgaatgggagcatatacccaaggtttccacaccctggctgcggggatgcaattgcccga

SEQ ID NO: 574 - DNA, 200 bp, Amaranthus rudis
agcaccacccggtaggaccttgatcttgagctacattggaggtgctacaaatcttggcatattacaaaaggcaagtcatttatacaattatatgtgtccttgtatcctcaaataagtcgtatcaatcctgacgacatgcttctatcaatgcagagtgaagatgaacttgcggagacagttgataaggatctcagaaaaat

SEQ ID NO: 575 - DNA, 200 bp, Amaranthus rudis
atttttctgagatccttatcaactgtctccgcaagttcatcttcactctgcattgatagaagcatgtcgtcaggattgatacgacttatttgaggatacaaggacacatataattgtataaatgacttgccttttgtaatatgccaagatttgtagcacctccaatgtagctcaagatcaaggtcctaccgggtggtgct

SEQ ID NO: 576 - DNA, 200 bp, Amaranthus rudis
cagttgataaggatctcagaaaaattctgataaatccaaatgcgaaaggcagccgtgttctgggagtgagagtatggccaaaggcaatcccccaatttttagttggtcactttgatctgctagatgctgcaaaagctggtttggcaaatgctgggctaaaggggttgtttcttggtggtaattatgtatcaggtgttgcc

SEQ ID NO: 577 - DNA, 200 bp, Amaranthus rudis
ggcaacacctgatacataattaccaccaagaaacaacccctttagcccagcatttgccaaaccagcttttgcagcatctagcagatcaaagtgaccaactaaaaattgggggattgcctttggccatactctcactcccagaacacggctgcctttcgcatttggatttatcagaatttttctgagatccttatcaactg

SEQ ID NO: 578 - DNA, 200 bp, Amaranthus spinosus
agagagagtgcaagagagatgagtgccatggcgttatcgagcagcattctacaatgtccgccgcactccgacttctctttccgcttttctgcttatacaccaacccgctcccccttcttcttcggaagacctccaaaattatcatatatccattgttccacaagctcaagctcaactgccaattaccagaacacgattac

SEQ ID NO: 579 - DNA, 200 bp, Amaranthus spinosus
gtaatcgtgttctggtaattggcagttgagcttgagcttgtggaacaatggatatatgataattttggaggtcttccgaagaagaagggggagcgggttggtgtataagcagaaaagcggaaagagaagtcggagtgcggcggacattgtagaatgctgctcgataacgccatggcactcatctctcttgcactctctct

SEQ ID NO: 580 - DNA, 200 bp, Amaranthus spinosus
ctgccaattaccagaacacgattacgacccaaggagaaggagataaagtattggattgtgtaattgttggagctggtatcagtggactttgcattgctcaagctctttctaccaaacacattcaatccaatctcaatttcattgtcactgaagctaaaaaccgtgttggaggtaatatcactaccatggagtccgatggc

SEQ ID NO: 581 - DNA, 200 bp, Amaranthus spinosus
gccatcggactccatggtagtgatattacctccaacacggtttttagcttcagtgacaatgaaattgagattggattgaatgtgtttggtagaaagagcttgagcaatgcaaagtccactgataccagctccaacaattacacaatccaatactttatctccttctccttgggtcgtaatcgtgttctggtaattggcag

SEQ ID NO: 582 - DNA, 200 bp, Amaranthus spinosus
tatcactaccatggagtccgatggctatatctgggaagagggtcctaatagtttccaaccctccgatcctgtgcttactatggcggttgacagtggattgaaagatgatttggtcttgggagatcctaatgcccctcgtttcgtgctctggaatggtaaattaaggcctgttccttccaaacctacggaccttccctttt

SEQ ID NO: 583 - DNA, 200 bp, Amaranthus spinosus
aaaagggaaggtccgtaggtttggaaggaacaggccttaatttaccattccagagcacgaaacgaggggcattaggatctcccaagaccaaatcatctttcaatccactgtcaaccgccatagtaagcacaggatcggagggttggaaactattaggaccctcttcccagatatagccatcggactccatggtagtgata

SEQ ID NO: 584 - DNA, 200 bp, Amaranthus spinosus
tccaaacctacggaccttcccttttttgatctcatgagctttcctggtaagattagggctggtcttggtgctcttggtcttcgtcctcctcctccttcttatgaggagtctgttgaagaatttgtgcgccgtaatctcggtgatgaggttttcgaacgcttgattgaacccttttgttctggtgtgtatgctggtgatcc

SEQ ID NO: 585 - DNA, 200 bp, Amaranthus spinosus
ggatcaccagcatacacaccagaacaaaagggttcaatcaagcgttcgaaaacctcatcaccgagattacggcgcacaaattcttcaacagactcctcataagaaggaggaggaggacgaagaccaagagcaccaagaccagccctaatcttaccaggaaagctcatgagatcaaaaaagggaaggtccgtaggtttgga

SEQ ID NO: 586 - DNA, 200 bp, Amaranthus spinosus
gttctggtgtgtatgctggtgatccttcaaagttgagtatgaaagctgcatttggaaaggtctggaccttagagcaaaagggtggtagtatcatcgccggtacactcaaaactattcaggaaaggaagaataatcctccaccgcctcgagacccccgccttcctaaacctaagggccagactgttggatcctttaggaaa

SEQ ID NO: 587 - DNA, 200 bp, Amaranthus spinosus
tttcctaaaggatccaacagtctggcccttaggtttaggaaggcgggggtctcgaggcggtggaggattattcttcctttcctgaatagttttgagtgtaccggcgatgatactaccacccttttgctctaaggtccagacctttccaaatgcagctttcatactcaactttgaaggatcaccagcatacacaccagaac

SEQ ID NO: 588 - DNA, 200 bp, Amaranthus spinosus
ccagactgttggatcctttaggaaagggctcattatgttacctaccgccattgctgctaggcttggcagtaaagtcaaactatcatggacactttctaatattgataagtcgctcaatggtgaatacaatctcacttatcaaacacccgatggaccggtttctgttaggaccaaagcggttgtcatgactgtcccttcat

SEQ ID NO: 589 - DNA, 200 bp, Amaranthus spinosus
atgaagggacagtcatgacaaccgctttggtcctaacagaaaccggtccatcgggtgtttgataagtgagattgtattcaccattgagcgacttatcaatattagaaagtgtccatgatagtttgactttactgccaagcctagcagcaatggcggtaggtaacataatgagccctttcctaaaggatccaacagtctgg

SEQ ID NO: 590 - DNA, 200 bp, Amaranthus spinosus
gcggttgtcatgactgtcccttcatacattgcaagtagcctgcttcgtccgctctcagatgttgctgcagattctctttctaaattttactatccaccagtcgcagcagtgtccctttcttatcccaaagaagcaattagaccagaatgcttgatcgatggagaactaaaaggattcgggcaattgcatccccgcagcca

SEQ ID NO: 591 - DNA, 200 bp, Amaranthus spinosus
tggctgcggggatgcaattgcccgaatccttttagttctccatcgatcaagcattctggtctaattgcttctttgggataagaaagggacactgctgcgactggtggatagtaaaatttagaaagagaatctgcagcaacatctgagagcggacgaagcaggctacttgcaatgtatgaagggacagtcatgacaaccgc

SEQ ID NO: 592 - DNA, 200 bp, Amaranthus spinosus
tcgggcaattgcatccccgcagccagggtgtggaaaccttgggaacaatttatagttcatctcttttccctggtcgagcaccacccggtaggaccttgatcttgagctacattggaggtgctacaaatgttggcatattacaaaagagtgaagatgaacttgcggagacagttgacaaggatctcagaaaaattctgata

SEQ ID NO: 593 - DNA, 200 bp, Amaranthus spinosus
tatcagaatttttctgagatccttgtcaactgtctccgcaagttcatcttcactcttttgtaatatgccaacatttgtagcacctccaatgtagctcaagatcaaggtcctaccgggtggtgctcgaccagggaaaagagatgaactataaattgttcccaaggtttccacaccctggctgcggggatgcaattgcccga

SEQ ID NO: 594 - DNA, 200 bp, Amaranthus thunbergii
agagagtgcgagagaaatgagtgcgatggcgttatcgagcagcattctacaatgtccgccgcactccgacatctcgttccgcttttctgctcattcaccaacccactcccccatcttcttcggaagaccacgaaaattatcatatatccattgttccacaagctcaagctcaactgccaattaccagaacacgattacga

SEQ ID NO: 595 - DNA, 200 bp, Amaranthus thunbergii
tcgtaatcgtgttctggtaattggcagttgagcttgagcttgtggaacaatggatatatgataattttcgtggtcttccgaagaagatgggggagtgggttggtgaatgagcagaaaagcggaacgagatgtcggagtgcggcggacattgtagaatgctgctcgataacgccatcgcactcatttctctcgcactctct

SEQ ID NO: 596 - DNA, 200 bp, Amaranthus thunbergii
gccaattaccagaacacgattacgacccaaggagaaggagataaagtattagattgtgtaattgttggagctggtatcagtggactttgcattgcgcaggctctttctaccaaacacattcaatccaatctcaatttcattgtcactgaagctaaacatcgtgttggaggtaatatcactaccatggagtccgatggcta

SEQ ID NO: 597 - DNA, 200 bp, Amaranthus thunbergii
tagccatcggactccatggtagtgatattacctccaacacgatgtttagcttcagtgacaatgaaattgagattggattgaatgtgtttggtagaaagagcctgcgcaatgcaaagtccactgataccagctccaacaattacacaatctaatactttatctccttctccttgggtcgtaatcgtgttctggtaattggc

SEQ ID NO: 598 - DNA, 200 bp, Amaranthus thunbergii
tcactaccatggagtccgatggctatatctgggaagagggtcctaatagtttccaaccctctgatcctgtgcttactatggcggttgacagtggattgaaagacgatttggtcttgggagatcctaatgcccctcgtttcgtgctctggaatggtaaattaaggcctgttccttccaaacctacggaccttccctttttt

SEQ ID NO: 599 - DNA, 200 bp, Amaranthus thunbergii
aaaaaagggaaggtccgtaggtttggaaggaacaggccttaatttaccattccagagcacgaaacgaggggcattaggatctcccaagaccaaatcgtctttcaatccactgtcaaccgccatagtaagcacaggatcagagggttggaaactattaggaccctcttcccagatatagccatcggactccatggtagtga

SEQ ID NO: 600 - DNA, 200 bp, Amaranthus thunbergii
caaacctacggaccttcccttttttgatctcatgagctttcctggtaagattagggctggtcttggtgcacttggtcttcgtcgtcctcctcctccttcttcttatgaggaatctgttgaagaatttgtgcgccgtaatctcggcgatgaggtcttcgaacgcttgatcgaacccttttgttctggtgtgtatgctggtg

SEQ ID NO: 601 - DNA, 200 bp, Amaranthus thunbergii
caccagcatacacaccagaacaaaagggttcgatcaagcgttcgaagacctcatcgccgagattacggcgcacaaattcttcaacagattcctcataagaagaaggaggaggaggacgacgaagaccaagtgcaccaagaccagccctaatcttaccaggaaagctcatgagatcaaaaaagggaaggtccgtaggtttg

SEQ ID NO: 602 - DNA, 200 bp, Amaranthus thunbergii
ttttgttctggtgtgtatgctggtgatcctacaaagttgagtatgaaagctgcatttggaaaggtctggaccttagagcaaaagggtggtagtatcatcgccggtacactcaaaactattcaggaaaggaagaataatcctccaccccctcgagacccccgccttcctaaacctaagggccagactgttggatcctttag

SEQ ID NO: 603 - DNA, 200 bp, Amaranthus thunbergii
ctaaaggatccaacagtctggcccttaggtttaggaaggcgggggtctcgagggggtggaggattattcttcctttcctgaatagttttgagtgtaccggcgatgatactaccacccttttgctctaaggtccagacctttccaaatgcagctttcatactcaactttgtaggatcaccagcatacacaccagaacaaaa

SEQ ID NO: 604 - DNA, 200 bp, Amaranthus thunbergii
agggccagactgttggatcctttaggaaagggctcattatgttacctaccgccattgctgctaggcttggcagtaaagtcaaactatcgtggacactttctaatattgataagtcgctcaatggtgaatacattctcacttatcaaacacccgatggaccggtttctgttaggaccaaagcggttgtcatgactgtccct

SEQ ID NO: 605 - DNA, 200 bp, Amaranthus thunbergii
agggacagtcatgacaaccgctttggtcctaacagaaaccggtccatcgggtgtttgataagtgagaatgtattcaccattgagcgacttatcaatattagaaagtgtccacgatagtttgactttactgccaagcctagcagcaatggcggtaggtaacataatgagccctttcctaaaggatccaacagtctggccct

SEQ ID NO: 606 - DNA, 200 bp, Amaranthus thunbergii
caaagcggttgtcatgactgtcccttcatacattgcaagtagcctgcttcgtccgctctcagatgttgctgcagattctctttctaagttttactatccaccagtcgcagcagtgtccctttcttatcccaaagaagcaattagaccagaatgcttgatcgatggagaactaaaaggattcgggcaattgcatccccgca

SEQ ID NO: 607 - DNA, 200 bp, Amaranthus thunbergii
tgcggggatgcaattgcccgaatccttttagttctccatcgatcaagcattctggtctaattgcttctttgggataagaaagggacactgctgcgactggtggatagtaaaacttagaaagagaatctgcagcaacatctgagagcggacgaagcaggctacttgcaatgtatgaagggacagtcatgacaaccgctttg

SEQ ID NO: 608 - DNA, 200 bp, Amaranthus thunbergii
ggattcgggcaattgcatccccgcagccagggtgtggaaaccttgggaacaatttatagttcatctcttttccctggtcgagcaccacccggtaggaccttgatcttgagctacattggaggtgctacaaatgttggaatattacaaaagagtgaagatgaacttgcggagacagttgataaggatctcagaaaaattct

SEQ ID NO: 609 - DNA, 200 bp, Amaranthus thunbergii
agaatttttctgagatccttatcaactgtctccgcaagttcatcttcactcttttgtaatattccaacatttgtagcacctccaatgtagctcaagatcaaggtcctaccgggtggtgctcgaccagggaaaagagatgaactataaattgttcccaaggtttccacaccctggctgcggggatgcaattgcccgaatcc

SEQ ID NO: 610 - DNA, 200 bp, Amaranthus viridis
ggataaccagagagagtgcgagagaaatgagtgcgatggcgttatcgagcagcattctacaatgtccgccgcactccgacatctcgttccgcttttctgctcattcaccaacccactcccccatcttcttcggaagaccacgaaaattatcatatatccattgttccacaagctcaagctcaactgccaattaccagaac

SEQ ID NO: 611 - DNA, 200 bp, Amaranthus viridis
gttctggtaattggcagttgagcttgagcttgtggaacaatggatatatgataattttcgtggtcttccgaagaagatgggggagtgggttggtgaatgagcagaaaagcggaacgagatgtcggagtgcggcggacattgtagaatgctgctcgataacgccatcgcactcatttctctcgcactctctctggttatcc

SEQ ID NO: 612 - DNA, 200 bp, Amaranthus viridis
aagctcaactgccaattaccagaacacgattacgacccaaggagaaggagataaagtattagattgtgtaattgttggagctggtatcagtggactttgcattgcgcaggctctttctaccaaacacattcaatccaatctcaatttcattgtcactgaagctaaacatcgtgttggaggtaatattactaccatggagt

SEQ ID NO: 613 - DNA, 200 bp, Amaranthus viridis
actccatggtagtaatattacctccaacacgatgtttagcttcagtgacaatgaaattgagattggattgaatgtgtttggtagaaagagcctgcgcaatgcaaagtccactgataccagctccaacaattacacaatctaatactttatctccttctccttgggtcgtaatcgtgttctggtaattggcagttgagctt

SEQ ID NO: 614 - DNA, 200 bp, Amaranthus viridis
ggaggtaatattactaccatggagtccgatggctatatctgggaagagggtcctaatagtttccaaccctctgatcctgtgcttactatggcggttgacagtggattgaaagacgatttggtcttgggagatcctaatgcccctcgtttcgtgctctggaatggtaaattaaggcctgttccttccaaacctacggacct

SEQ ID NO: 615 - DNA, 200 bp, Amaranthus viridis
aggtccgtaggtttggaaggaacaggccttaatttaccattccagagcacgaaacgaggggcattaggatctcccaagaccaaatcgtctttcaatccactgtcaaccgccatagtaagcacaggatcagagggttggaaactattaggaccctcttcccagatatagccatcggactccatggtagtaatattacctcc

SEQ ID NO: 616 - DNA, 200 bp, Amaranthus viridis
ctgttccttccaaacctacggaccttcccttttttgatctcatgagctttcctggtaagattagggctggtcttggtgcacttggtcttcgtcgtcctcctcctccttcttcttatgaggaatctgttgaagaatttgtgcgccgtaatctcggcgatgaggtcttcgaacgcttgatcgaacccttttgttctggtgtg

SEQ ID NO: 617 - DNA, 200 bp, Amaranthus viridis
cacaccagaacaaaagggttcgatcaagcgttcgaagacctcatcgccgagattacggcgcacaaattcttcaacagattcctcataagaagaaggaggaggaggacgacgaagaccaagtgcaccaagaccagccctaatcttaccaggaaagctcatgagatcaaaaaagggaaggtccgtaggtttggaaggaacag

SEQ ID NO: 618 - DNA, 200 bp, Amaranthus viridis
gatcgaacccttttgttctggtgtgtatgctggtgatcctacaaagttgagtatgaaagctgcatttggaaaggtctggaccttagagcaaaagggtggtagtatcatcgccggtacactcaaaactattcaggaaaggaagaataatcctccaccccctcgagacccccgccttcctaaacctaagggccagactgttg

SEQ ID NO: 619 - DNA, 200 bp, Amaranthus viridis
caacagtctggcccttaggtttaggaaggcgggggtctcgagggggtggaggattattcttcctttcctgaatagttttgagtgtaccggcgatgatactaccacccttttgctctaaggtccagacctttccaaatgcagctttcatactcaactttgtaggatcaccagcatacacaccagaacaaaagggttcgatc

SEQ ID NO: 620 - DNA, 200 bp, Amaranthus viridis
cctaaacctaagggccagactgttggatcctttaggaaagggctcattatgttacctaccgccattgctgctaggcttggcagtaaagtcaaactatcgtggacactttctaatattgataagtcgctcaatggtgaatacaatctcacttatcaaacacccgatggaccggtttctgttaggaccaaagcggttgtcat

SEQ ID NO: 621 - DNA, 200 bp, Amaranthus viridis
atgacaaccgctttggtcctaacagaaaccggtccatcgggtgtttgataagtgagattgtattcaccattgagcgacttatcaatattagaaagtgtccacgatagtttgactttactgccaagcctagcagcaatggcggtaggtaacataatgagccctttcctaaaggatccaacagtctggcccttaggtttagg

SEQ ID NO: 622 - DNA, 200 bp, Amaranthus viridis
ctgttaggaccaaagcggttgtcatgactgtcccttcatacattgcaagtagcctgcttcgtccgctctcagatgttgctgcagattctctttctaagttttactatccaccagtcgcagcagtgtccctttcttatcccaaagaagcaattagaccagaatgcttgatcgatggagaactaaaaggattcgggcaattg

SEQ ID NO: 623 - DNA, 200 bp, Amaranthus viridis
caattgcccgaatccttttagttctccatcgatcaagcattctggtctaattgcttctttgggataagaaagggacactgctgcgactggtggatagtaaaacttagaaagagaatctgcagcaacatctgagagcggacgaagcaggctacttgcaatgtatgaagggacagtcatgacaaccgctttggtcctaacag

SEQ ID NO: 624 - DNA, 200 bp, Amaranthus viridis
agaactaaaaggattcgggcaattgcatccccgcagccagggtgtggaaaccttgggaacaatttatagttcatctcttttccctggtcgagcaccacccggtaggaccttgatcttgagctacattggaggtgctacaaatgttggaatattacaaaagagtgaagatgaacttgcggagacagttgataaggatctca

SEQ ID NO: 625 - DNA, 200 bp, Amaranthus viridis
tgagatccttatcaactgtctccgcaagttcatcttcactcttttgtaatattccaacatttgtagcacctccaatgtagctcaagatcaaggtcctaccgggtggtgctcgaccagggaaaagagatgaactataaattgttcccaaggtttccacaccctggctgcggggatgcaattgcccgaatccttttagttct

SEQ ID NO: 626 - DNA, 200 bp, Amaranthus viridis
gcggagacagttgataaggatctcagaaaaattctgataaatccaaatgcgaaaggcagccgtgttctgggagtgagagtatggccaaaggcaatcccccaatttttagttggtcactttgatctgctagatgctgcaaaagctggtttggcaaatgctgggctaaaggggttgtttcttggtggtaattatgtatcagg

SEQ ID NO: 627 - DNA, 200 bp, Amaranthus viridis
cctgatacataattaccaccaagaaacaacccctttagcccagcatttgccaaaccagcttttgcagcatctagcagatcaaagtgaccaactaaaaattgggggattgcctttggccatactctcactcccagaacacggctgcctttcgcatttggatttatcagaatttttctgagatccttatcaactgtctccgc

SEQ ID NO: 628 - DNA, 200 bp, Amaranthus viridis
ttcttggtggtaattatgtatcaggtgttgccttggggaggtgtatagagggtgcttatgactctgcatctcaggtagtggatttcctctcacagtacaaagacaagtagtcaatagggctccaccttcctggttaactaacttttgtagctcttgtaatttgtatcatgtaatattattcagatgtaaaagatacagtc

SEQ ID NO: 629 - DNA, 200 bp, Amaranthus viridis
gactgtatcttttacatctgaataatattacatgatacaaattacaagagctacaaaagttagttaaccaggaaggtggagccctattgactacttgtctttgtactgtgagaggaaatccactacctgagatgcagagtcataagcaccctctatacacctccccaaggcaacacctgatacataattaccaccaagaa

SEQ ID NO: 630 - DNA, 200 bp, Ambrosia trifida
atcccaccgcttttgcgctttgcgcctcggttttggacctcgtcgctttagtgcgcttcgcgctttttaaaaccaagcttctatcgagtttaatgactaaaatttagtaaaatataatgaccaatatggaaggtatttcatgacaattaaccctaaatatattaggtaaccacaaaggagggctctctgttgggaaagca

SEQ ID NO: 631 - DNA, 200 bp, Ambrosia trifida
tgctttcccaacagagagccctcctttgtggttacctaatatatttagggttaattgtcatgaaataccttccatattggtcattatattttactaaattttagtcattaaactcgatagaagcttggttttaaaaagcgcgaagcgcactaaagcgacgaggtccaaaaccgaggcgcaaagcgcaaaagcggtgggat

SEQ ID NO: 632 - DNA, 200 bp, Ambrosia trifida
aggagggctctctgttgggaaagcaatatcctccggatgcaaagcagccgaatccgtgattgcatatttggattcttattcggaccagaagtagaaggatgggtgttgctagattatgttttaaccggtaaactttatttcttatatcttatttttattcttatttttcaatgcaaagagtcaaacgacgcaagtgtgat

SEQ ID NO: 633 - DNA, 200 bp, Ambrosia trifida
atcacacttgcgtcgtttgactctttgcattgaaaaataagaataaaaataagatataagaaataaagtttaccggttaaaacataatctagcaacacccatccttctacttctggtccgaataagaatccaaatatgcaatcacggattcggctgctttgcatccggaggatattgctttcccaacagagagccctcct

SEQ ID NO: 634 - DNA, 200 bp, Ambrosia trifida
cgcacgcaatggttttgcacttttgcccacagtaaagaaaaggtagcctctctacccgacccgacccgacccgaaccaaaccgataaaaacaaataccaactctgataaccagattactcacagagaaaccaacaatggcttcaccaactatagttgacaaccaaagttagggttcttctaaattctaattacattttat

SEQ ID NO: 635 - DNA, 200 bp, Ambrosia trifida
ataaaatgtaattagaatttagaagaaccctaactttggttgtcaactatagttggtgaagccattgttggtttctctgtgagtaatctggttatcagagttggtatttgtttttatcggtttggttcgggtcgggtcgggtcgggtagagaggctaccttttctttactgtgggcaaaagtgcaaaaccattgcgtgcg

SEQ ID NO: 636 - DNA, 200 bp, Ambrosia trifida
cttctaaattctaattacattttatcctaattttacttacacatttgtagcatttgcatctataattcagaaacctaatctaatttattaattaattaattaagtggttttgttttctctacagaacctgctaagagagttgctgttgttggtgctggtgtcaggtacttaaacttaaaacctaaaacagataattattt

SEQ ID NO: 637 - DNA, 200 bp, Ambrosia trifida
aaataattatctgttttaggttttaagtttaagtacctgacaccagcaccaacaacagcaactctcttagcaggttctgtagagaaaacaaaaccacttaattaattaattaataaattagattaggtttctgaattatagatgcaaatgctacaaatgtgtaagtaaaattaggataaaatgtaattagaatttagaag

SEQ ID NO: 638 - DNA, 200 bp, Ambrosia trifida
taaaacctaaaacagataattattttgcttatttactagattcacttattctgttcatgtaatttgctaaggtttgatcagtcaattatatacatttagggatttaggagttacagaatgttttgatataataatatatacaatttgtaaaaatatatagatcatgattgataattagaggaatggaatattttgataat

SEQ ID NO: 639 - DNA, 200 bp, Ambrosia trifida
attatcaaaatattccattcctctaattatcaatcatgatctatatatttttacaaattgtatatattattatatcaaaacattctgtaactcctaaatccctaaatgtatataattgactgatcaaaccttagcaaattacatgaacagaataagtgaatctagtaaataagcaaaataattatctgttttaggtttta

SEQ ID NO: 640 - DNA, 200 bp, Ambrosia trifida
tagaggaatggaatattttgataattgaaaaaacaatatgttacatttttttcagtggttgtgctgctgcttataagttaaagttacatggattgaatgtgactgtgtttgaagctgatgggagcgttggtgggaaactaaagagcgtttcgcaagatggtttaatatgggatgagggtgccaatactatggtatgtttt

SEQ ID NO: 641 - DNA, 200 bp, Ambrosia trifida
aaaacataccatagtattggcaccctcatcccatattaaaccatcttgcgaaacgctctttagtttcccaccaacgctcccatcagcttcaaacacagtcacattcaatccatgtaactttaacttataagcagcagcacaaccactgaaaaaaatgtaacatattgttttttcaattatcaaaatattccattcctcta

SEQ ID NO: 642 - DNA, 200 bp, Ambrosia trifida
gggtgccaatactatggtatgttttagtataatatgattggtttcactttgttagcattttttatgaggtttgttgtatgtgttaccttatgtagactgagagtgaggcagatgttagcagtttgattgatgatcttgggcttcgagataaacagcagtttgtaagttgttgtgtttgatatagctgccatacttcctat

SEQ ID NO: 643 - DNA, 200 bp, Ambrosia trifida
ataggaagtatggcagctatatcaaacacaacaacttacaaactgctgtttatctcgaagcccaagatcatcaatcaaactgctaacatctgcctcactctcagtctacataaggtaacacatacaacaaacctcataaaaaatgctaacaaagtgaaaccaatcatattatactaaaacataccatagtattggcaccc

SEQ ID NO: 644 - DNA, 200 bp, Ambrosia trifida
ttgatatagctgccatacttcctatagcttgtgtggtaaattatatctatgaacatatgcaattattttgtaaaatgacaagaaacagattctttgttttatttgtgtatgaataatgaatagataagactaaattcatttttaggtctgcttcgatttgtcttttataatcactacgctgagttttaaatctttaacat

SEQ ID NO: 645 - DNA, 200 bp, Ambrosia trifida
atgttaaagatttaaaactcagcgtagtgattataaaagacaaatcgaagcagacctaaaaatgaatttagtcttatctattcattattcatacacaaataaaacaaagaatctgtttcttgtcattttacaaaataattgcatatgttcatagatataatttaccacacaagctataggaagtatggcagctatatcaa

SEQ ID NO: 646 - DNA, 200 bp, Ambrosia trifida
acgctgagttttaaatctttaacattatttcctgttgcagccaatttcacagcacaagcggtacattgtaagaaatggaaaacctgtattggtatggatatctcaacaccacttaactagtgatcctctatttttagtaaaattcatttactaaaaaaaggggggctgaaaaattaaaatttaatgtgaattgtgcttta

SEQ ID NO: 647 - DNA, 200 bp, Ambrosia trifida
taaagcacaattcacattaaattttaatttttcagcccccctttttttagtaaatgaattttactaaaaatagaggatcactagttaagtggtgttgagatatccataccaatacaggttttccatttcttacaatgtaccgcttgtgctgtgaaattggctgcaacaggaaataatgttaaagatttaaaactcagcgt

SEQ ID NO: 648 - DNA, 200 bp, Ambrosia trifida
aaaatttaatgtgaattgtgctttattaggtttgaatgcttaacctcatcaaagtcaaataataacatgagtagtctgttgctctggaaacccgtattgcaacccatgaaaagatccaaatcacggtttttcaaacactgttttatacttttatgtccagggaacaaaaaaccaaaatctttcctgagtgaggccttagt

SEQ ID NO: 649 - DNA, 200 bp, Ambrosia trifida
actaaggcctcactcaggaaagattttggttttttgttccctggacataaaagtataaaacagtgtttgaaaaaccgtgatttggatcttttcatgggttgcaatacgggtttccagagcaacagactactcatgttattatttgactttgatgaggttaagcattcaaacctaataaagcacaattcacattaaatttt

SEQ ID NO: 650 - DNA, 200 bp, Ambrosia trifida
aatctttcctgagtgaggccttagttgtcttcttattatttatcttttatatttatcaagttcatgtctctctatattgaccatgactcagtctatatcatgattgcagataccttctaacccaattgcactgattagcagcagttttctttccactcagtcaaaggtatgttagtagctcctgccaccttgaaggttca

SEQ ID NO: 651 - DNA, 200 bp, Ambrosia trifida
tgaaccttcaaggtggcaggagctactaacatacctttgactgagtggaaagaaaactgctgctaatcagtgcaattgggttagaaggtatctgcaatcatgatatagactgagtcatggtcaatatagagagacatgaacttgataaatataaaagataaataataagaagacaactaaggcctcactcaggaaagatt

SEQ ID NO: 652 - DNA, 200 bp, Ambrosia trifida
tagctcctgccaccttgaaggttcaagcataagtatgccatatcttattgagatcgttcactcgcatactatcttcttaatgttgttcaatgttgagattaaagtgcaatctttattctattttgcttaatcaaatataatgtttatttattttaattttattaaaaaagtatctacgtaagtattacaaaaagtaaaaa

SEQ ID NO: 653 - DNA, 200 bp, Ambrosia trifida
tttttactttttgtaatacttacgtagatacttttttaataaaattaaaataaataaacattatatttgattaagcaaaatagaataaagattgcactttaatctcaacattgaacaacattaagaagatagtatgcgagtgaacgatctcaataagatatggcatacttatgcttgaaccttcaaggtggcaggagcta

SEQ ID NO: 654 - DNA, 200 bp, Ambrosia trifida
acgtaagtattacaaaaagtaaaaactcttccccgttgatgagatgatctcaaagtctaatgtcatatatctagtactctcaataagctaacataaacagtatagtctattaaaagggtccccaacatcgaaatgagtaacgctgctttgagttaagggtgcaaaatgtcatataataaataaagatgttctatgatgct

SEQ ID NO: 655 - DNA, 200 bp, Ambrosia trifida
agcatcatagaacatctttatttattatatgacattttgcacccttaactcaaagcagcgttactcatttcgatgttggggacccttttaatagactatactgtttatgttagcttattgagagtactagatatatgacattagactttgagatcatctcatcaacggggaagagtttttactttttgtaatacttacgt

SEQ ID NO: 656 - DNA, 200 bp, Ambrosia trifida
ataaataaagatgttctatgatgctttgatatttgtttcgcactttcacttatcccccatggtatttttaacttgtttttaaaagtagaagattttttttattgatgtgcatgcgattattatcggctttgtttgcaaattttacaggttcaaattcttttagagccatttttatggaagaagactaagtcatctgacga

SEQ ID NO: 657 - DNA, 200 bp, Ambrosia trifida
tcgtcagatgacttagtcttcttccataaaaatggctctaaaagaatttgaacctgtaaaatttgcaaacaaagccgataataatcgcatgcacatcaataaaaaaaatcttctacttttaaaaacaagttaaaaataccatgggggataagtgaaagtgcgaaacaaatatcaaagcatcatagaacatctttatttat

SEQ ID NO: 658 - DNA, 200 bp, Ambrosia trifida
ggaagaagactaagtcatctgacgaacccgagaggtaaaatacatagccttgttccatttcatcggcttgaagtagttatattcggtacatgccattaggttcttaaccatgtattttgcagtgttggaggattctttcaacgtcattttgggaaggaggtgtttgtatattcgacataatgttttgtttctgttctgat

SEQ ID NO: 659 - DNA, 200 bp, Ambrosia trifida
atcagaacagaaacaaaacattatgtcgaatatacaaacacctccttcccaaaatgacgttgaaagaatcctccaacactgcaaaatacatggttaagaacctaatggcatgtaccgaatataactacttcaagccgatgaaatggaacaaggctatgtattttacctctcgggttcgtcagatgacttagtcttcttcc

SEQ ID NO: 660 - DNA, 200 bp, Ambrosia trifida
cataatgttttgtttctgttctgattctgtttctcatagttattaatatttgacctgcttatctaaggttgttgagtatctcattgatccagttgttgcgggaacaagcggtggagatcctgaatcactctctgtgagtaactattgtttctccacacatttttttggagaaatatacattgctgctttacattaacgac

SEQ ID NO: 661 - DNA, 200 bp, Ambrosia trifida
gtcgttaatgtaaagcagcaatgtatatttctccaaaaaaatgtgtggagaaacaatagttactcacagagagtgattcaggatctccaccgcttgttcccgcaacaactggatcaatgagatactcaacaaccttagataagcaggtcaaatattaataactatgagaaacagaatcagaacagaaacaaaacattatg

SEQ ID NO: 662 - DNA, 200 bp, Ambrosia trifida
tacattgctgctttacattaacgaccttaaaccgtttaatatattgcttgaattcttttacttttccacacagatgcgtcatgcatttcctgagctatgggatttagagagaaggtatgtttgtaacaaacagtagtaattcttcttcaaacgatctgtggaataatgacttttgaccacttatttctgaagacctaaaa

SEQ ID NO: 663 - DNA, 200 bp, Ambrosia trifida
ttttaggtcttcagaaataagtggtcaaaagtcattattccacagatcgtttgaagaagaattactactgtttgttacaaacataccttctctctaaatcccatagctcaggaaatgcatgacgcatctgtgtggaaaagtaaaagaattcaagcaatatattaaacggtttaaggtcgttaatgtaaagcagcaatgta

SEQ ID NO: 664 - DNA, 200 bp, Ambrosia trifida
accacttatttctgaagacctaaaatcaatttaatacttacaactatttaattcaggtttggttcaatcatttctggggcatttcaatctatggtatcttccagaggtgggaaaaggaaaccttctggaaacagcaaacgtaggcgtggttccttttctttttttggtgggatgcaggtaagacgagggtgatttactga

SEQ ID NO: 665 - DNA, 200 bp, Ambrosia trifida
tcagtaaatcaccctcgtcttacctgcatcccaccaaaaaaagaaaaggaaccacgcctacgtttgctgtttccagaaggtttccttttcccacctctggaagataccatagattgaaatgccccagaaatgattgaaccaaacctgaattaaatagttgtaagtattaaattgattttaggtcttcagaaataagtggt

SEQ ID NO: 666 - DNA, 200 bp, Ambrosia trifida
aggtaagacgagggtgatttactgatttagataagaccctaaatttagttattgttatcttttaattaattacagatgttatttgggtcgttcatgcttttttgctatgcagacactcactgatgcactatgcaaagagattggaccccatgaagttaatcttcaatcaaaggtgcttgaaatgtcctacagctgcgatg

SEQ ID NO: 667 - DNA, 200 bp, Ambrosia trifida
catcgcagctgtaggacatttcaagcacctttgattgaagattaacttcatggggtccaatctctttgcatagtgcatcagtgagtgtctgcatagcaaaaaagcatgaacgacccaaataacatctgtaattaattaaaagataacaataactaaatttagggtcttatctaaatcagtaaatcaccctcgtcttacct

SEQ ID NO: 668 - DNA, 200 bp, Ambrosia trifida
cttgaaatgtcctacagctgcgatgataatgcggttggtaattggtcaatttattgtgctccagatcaaaacaaacaatttcagcaatcttttgatgctgtgatcatgactgtgagtgccttcattgggtaatcttttacttatcagtgacataaagttagttaatttcttgcattcttgatgaagatagttttttgtat

SEQ ID NO: 669 - DNA, 200 bp, Ambrosia trifida
atacaaaaaactatcttcatcaagaatgcaagaaattaactaactttatgtcactgataagtaaaagattacccaatgaaggcactcacagtcatgatcacagcatcaaaagattgctgaaattgtttgttttgatctggagcacaataaattgaccaattaccaaccgcattatcatcgcagctgtaggacatttcaag

SEQ ID NO: 670 - DNA, 200 bp, Ambrosia trifida
tcttgatgaagatagttttttgtatctttaaagtttattctgtgtcctctaggtagtatctggatattaatacatgggatgggaatttttttaatcttgagtttttctctgatggttattaagtgttagatgcatctaattttaactgacaaagaaaatattccccaattaggccccacttaacaatgtaaaagaaatga

SEQ ID NO: 671 - DNA, 200 bp, Ambrosia trifida
tcatttcttttacattgttaagtggggcctaattggggaatattttctttgtcagttaaaattagatgcatctaacacttaataaccatcagagaaaaactcaagattaaaaaaattcccatcccatgtattaatatccagatactacctagaggacacagaataaactttaaagatacaaaaaactatcttcatcaaga

SEQ ID NO: 672 - DNA, 200 bp, Ambrosia trifida
ccacttaacaatgtaaaagaaatgaagattacaaagacaggaagtccgtttctgcttaattttattccagaggtatgtttttttttcttctactaaagcattagttttagttctatcaaatctaacactgaatacagaaaacagctttaacatcgtcatccaattaaattgtgaaatatttatagtgtcatttcttagcc

SEQ ID NO: 673 - DNA, 200 bp, Ambrosia trifida
ggctaagaaatgacactataaatatttcacaatttaattggatgacgatgttaaagctgttttctgtattcagtgttagatttgatagaactaaaactaatgctttagtagaagaaaaaaaaacatacctctggaataaaattaagcagaaacggacttcctgtctttgtaatcttcatttcttttacattgttaagtgg

SEQ ID NO: 674 - DNA, 200 bp, Ambrosia trifida
atatttatagtgtcatttcttagccttttgtttttataatacaggtgagttatttgccattatcagtaataatctccactttcaagaaagaaaacgtgaagcagcctcttgagggttttggagttcttgttcctgccaaggagcaggaaaatggtttgaggacactaggtgaagcttgattctgccctccattattgttt

SEQ ID NO: 675 - DNA, 200 bp, Ambrosia trifida
aaacaataatggagggcagaatcaagcttcacctagtgtcctcaaaccattttcctgctccttggcaggaacaagaactccaaaaccctcaagaggctgcttcacgttttctttcttgaaagtggagattattactgataatggcaaataactcacctgtattataaaaacaaaaggctaagaaatgacactataaatat

SEQ ID NO: 676 - DNA, 200 bp, Ambrosia trifida
ttgattctgccctccattattgttttttatttgtttacattgacaccatagcaaaaattctgctatgcaggcaccctcttctcttccatgatgtttccagatcgggcctcagaagacgtgtacctttacaccacctttgttgggggtagtcgaaacaaagaactggccaaagcttcgaggtaggcaggcttgctcatcac

SEQ ID NO: 677 - DNA, 200 bp, Ambrosia trifida
gtgatgagcaagcctgcctacctcgaagctttggccagttctttgtttcgactacccccaacaaaggtggtgtaaaggtacacgtcttctgaggcccgatctggaaacatcatggaagagaagagggtgcctgcatagcagaatttttgctatggtgtcaatgtaaacaaataaaaaacaataatggagggcagaatcaa

SEQ ID NO: 678 - DNA, 200 bp, Ambrosia trifida
cgaggtaggcaggcttgctcatcaccatattcccccttaaaattgtagtgtgaacttaactcaagttctaattaattttttgtgcatatgttcaaaatctatgatagccttctgaaagacaaagtaaaaaaagtctttactgattaattgtggtaaaatcaatttattcataatgacgttaattgacaaataggtcttgg

SEQ ID NO: 679 - DNA, 200 bp, Ambrosia trifida
ccaagacctatttgtcaattaacgtcattatgaataaattgattttaccacaattaatcagtaaagactttttttactttgtctttcagaaggctatcatagattttgaacatatgcacaaaaaattaattagaacttgagttaagttcacactacaattttaagggggaatatggtgatgagcaagcctgcctacctcg

SEQ ID NO: 680 - DNA, 200 bp, Ambrosia trifida
acgttaattgacaaataggtcttggaaactttcctagtagaggatatgttgtaacttttaactcaaaaatctttcttgcaaaatagggacgagttgaagcagatagtaacttctgacctcagacagttgcttggaacagaaggggagccaaaatttctaacgtaagggcacaacgctatttcagtttaacagtaatcttt

SEQ ID NO: 681 - DNA, 200 bp, Ambrosia trifida
aaagattactgttaaactgaaatagcgttgtgcccttacgttagaaattttggctccccttctgttccaagcaactgtctgaggtcagaagttactatctgcttcaactcgtccctattttgcaagaaagatttttgagttaaaagttacaacatatcctctactaggaaagtttccaagacctatttgtcaattaacgt

SEQ ID NO: 682 - DNA, 200 bp, Ambrosia trifida
ctatttcagtttaacagtaatctttgctagaataagaaatgtaaccgcttgcctacctatggtctttttatctgttaaacaaaattttgtttaataaccactagcctggtgtagtggcaaaggtgtatctccctcatccaagaggtgttgggttctagtctcacttgagacaaggggaacattataagcggagtaaaaaa

SEQ ID NO: 683 - DNA, 200 bp, Ambrosia trifida
ttttttactccgcttataatgttccccttgtctcaagtgagactagaacccaacacctcttggatgagggagatacacctttgccactacaccaggctagtggttattaaacaaaattttgtttaacagataaaaagaccataggtaggcaagcggttacatttcttattctagcaaagattactgttaaactgaaatag

SEQ ID NO: 684 - DNA, 200 bp, Ambrosia trifida
ggaacattataagcggagtaaaaaattagccgtttaaaaaaaaaaaagtttgtaatttgaagttttccatcatgaactgaaacagttgctaaaatgtaacaagaagttattaaagtcttgaggtacatagatatatacacaatgtaaatatggcttacggagttgtgaggttgattgcagtcactattattggagcaaag

SEQ ID NO: 685 - DNA, 200 bp, Ambrosia trifida
ctttgctccaataatagtgactgcaatcaacctcacaactccgtaagccatatttacattgtgtatatatctatgtacctcaagactttaataacttcttgttacattttagcaactgtttcagttcatgatggaaaacttcaaattacaaacttttttttttttaaacggctaattttttactccgcttataatgttcc

SEQ ID NO: 686 - DNA, 200 bp, Ambrosia trifida
tgcagtcactattattggagcaaagcatttccattgtatgggcgtgactatggttcagttattgaagcaattgagaagatggaaaaagagctacccggttacttttatgcaggtaacatgttttgtcttgaaaataaaaatggacaaatcatatgttgatgagtagaggtggcaattttgacctattataacttacagag

SEQ ID NO: 687 - DNA, 200 bp, Ambrosia trifida
ctctgtaagttataataggtcaaaattgccacctctactcatcaacatatgatttgtccatttttattttcaagacaaaacatgttacctgcataaaagtaaccgggtagctctttttccatcttctcaattgcttcaataactgaaccatagtcacgcccatacaatggaaatgctttgctccaataatagtgactgca

SEQ ID NO: 688 - DNA, 200 bp, Ambrosia trifida
gactgacagagaaaccaacaatggcttcaccaactatagttgacaaccaaaaacctgctaagagagttgctgttgttggtgctggtgtcagtggttgtgctgctgcttataagttaaagttacatggattgaatgtgactgtgtttgaagctgatgggagcgttggtgggaaactaaagagcgtttcgcaagatggttta

SEQ ID NO: 689 - DNA, 200 bp, Ambrosia trifida
taaaccatcttgcgaaacgctctttagtttcccaccaacgctcccatcagcttcaaacacagtcacattcaatccatgtaactttaacttataagcagcagcacaaccactgacaccagcaccaacaacagcaactctcttagcaggtttttggttgtcaactatagttggtgaagccattgttggtttctctgtcagtc

SEQ ID NO: 690 - DNA, 200 bp, Ambrosia trifida
aaagagcgtttcgcaagatggtttaatatgggatgagggtgccaatactatgactgagagtgaggcagatgttagcagtttgattgatgatcttgggcttcgagataaacagcagtttccaatttcacagcacaagcggtacattgtaagaaatggaaaacctgtattgataccttctaacccaattgcactgattagca

SEQ ID NO: 691 - DNA, 200 bp, Ambrosia trifida
tgctaatcagtgcaattgggttagaaggtatcaatacaggttttccatttcttacaatgtaccgcttgtgctgtgaaattggaaactgctgtttatctcgaagcccaagatcatcaatcaaactgctaacatctgcctcactctcagtcatagtattggcaccctcatcccatattaaaccatcttgcgaaacgctcttt

SEQ ID NO: 692 - DNA, 200 bp, Ambrosia trifida
tctaacccaattgcactgattagcagcagttttctttccactcagtcaaaggttcaaattcttttagagccatttttatggaagaagactaagtcatctgacgaacccgagagtgttggaggattctttcaacgtcattttgggaaggaggttgttgagtatctcattgatccagttgttgcgggaacaagcggtggaga

SEQ ID NO: 693 - DNA, 200 bp, Ambrosia trifida
tctccaccgcttgttcccgcaacaactggatcaatgagatactcaacaacctccttcccaaaatgacgttgaaagaatcctccaacactctcgggttcgtcagatgacttagtcttcttccataaaaatggctctaaaagaatttgaacctttgactgagtggaaagaaaactgctgctaatcagtgcaattgggttaga

SEQ ID NO: 694 - DNA, 200 bp, Ambrosia trifida
ttgttgcgggaacaagcggtggagatcctgaatcactctctatgcgtcatgcatttcctgagctatgggatttagagagaaggtttggttcaatcatttctggggcatttcaatctatggtatcttccagaggtgggaaaaggaaaccttctggaaacagcaaacgtaggcgtggttccttttctttttttggtgggatg

SEQ ID NO: 695 - DNA, 200 bp, Ambrosia trifida
catcccaccaaaaaaagaaaaggaaccacgcctacgtttgctgtttccagaaggtttccttttcccacctctggaagataccatagattgaaatgccccagaaatgattgaaccaaaccttctctctaaatcccatagctcaggaaatgcatgacgcatagagagtgattcaggatctccaccgcttgttcccgcaacaa

SEQ ID NO: 696 - DNA, 200 bp, Ambrosia trifida
ttccttttctttttttggtgggatgcagacactcactgatgcactatgcaaagagattggaccccatgaagttaatcttcaatcaaaggtgcttgaaatgtcctacagctgcgatgataatgcggttggtaattggtcaatttattgtgctccagatcaaaacaaacaatttcagcaatcttttgatgctgtgatcatga

SEQ ID NO: 697 - DNA, 200 bp, Ambrosia trifida
tcatgatcacagcatcaaaagattgctgaaattgtttgttttgatctggagcacaataaattgaccaattaccaaccgcattatcatcgcagctgtaggacatttcaagcacctttgattgaagattaacttcatggggtccaatctctttgcatagtgcatcagtgagtgtctgcatcccaccaaaaaaagaaaaggaa

SEQ ID NO: 698 - DNA, 200 bp, Ambrosia trifida
ggaacatcaaccagataagactttcccccaataaaaatgtcatctctcacaaacctcccttccctgaaccactaccgcacctggtcttccccacccattccccatcgaacccaatcatccaaaccccctaaccacctaaccacctatggtcccaccaataacaaccacaacagacgtacaacaacaaccttccgttgctc

SEQ ID NO: 699 - DNA, 200 bp, Ambrosia trifida
gagcaacggaaggttgttgttgtacgtctgttgtggttgttattggtgggaccataggtggttaggtggttagggggtttggatgattgggttcgatggggaatgggtggggaagaccaggtgcggtagtggttcagggaagggaggtttgtgagagatgacatttttattgggggaaagtcttatctggttgatgttcc

SEQ ID NO: 700 - DNA, 200 bp, Ambrosia trifida
gtacaacaacaaccttccgttgctcaatagccaacgacactccaatctctcctccaattaccaacgactccaattctaaacccttactggactgtgttattattggtgctggaatcagtggtctctgcattgcccaagccctagctactaaacatgctgacgtgtcacctgatgtggttgttacggaagcacgtgatagg

SEQ ID NO: 701 - DNA, 200 bp, Ambrosia trifida
cctatcacgtgcttccgtaacaaccacatcaggtgacacgtcagcatgtttagtagctagggcttgggcaatgcagagaccactgattccagcaccaataataacacagtccagtaagggtttagaattggagtcgttggtaattggaggagagattggagtgtcgttggctattgagcaacggaaggttgttgttgtac

SEQ ID NO: 702 - DNA, 200 bp, Ambrosia trifida
ggttgttacggaagcacgtgatagggttggaggtaatatatcgacggttgaacgtgatggatatttgtgggaagaaggtccgaatagttttcaaccgtctgatccgatgctcactatggtggtggatagtgggttgaaagatgatttggttttaggggaccccactgcaccacggtttgtattgtggggtggtggtttga

SEQ ID NO: 703 - DNA, 200 bp, Ambrosia trifida
tcaaaccaccaccccacaatacaaaccgtggtgcagtggggtcccctaaaaccaaatcatctttcaacccactatccaccaccatagtgagcatcggatcagacggttgaaaactattcggaccttcttcccacaaatatccatcacgttcaaccgtcgatatattacctccaaccctatcacgtgcttccgtaacaacc

SEQ ID NO: 704 - DNA, 200 bp, Ambrosia trifida
tttgtattgtggggtggtggtttgaagccagtgccttccagtccagctgatttgcctttctttgatctaatgagctttactggaaaactcagagccggttttggtgctctagggatccgccctccaccaccagatcgtgaggaatctgttgaagaatttgttcggcgtaaccttggtgatgaagtttttgaacgcttaat

SEQ ID NO: 705 - DNA, 200 bp, Ambrosia trifida
attaagcgttcaaaaacttcatcaccaaggttacgccgaacaaattcttcaacagattcctcacgatctggtggtggagggcggatccctagagcaccaaaaccggctctgagttttccagtaaagctcattagatcaaagaaaggcaaatcagctggactggaaggcactggcttcaaaccaccaccccacaatacaaa

SEQ ID NO: 706 - DNA, 200 bp, Ambrosia trifida
gtgatgaagtttttgaacgcttaatagaaccattttgttcaggtgtttatgctggcgacccatcaaaacttagtatgaaagcagcatttggtaaagtttggaagctggagaagaatggtggtagcattattggtggagcattcaaagcaatccaagcaaaaataagagtaccaagcctcctcgggacccgagattaccaa

SEQ ID NO: 707 - DNA, 200 bp, Ambrosia trifida
ttggtaatctcgggtcccgaggaggcttggtactcttatttttgcttggattgctttgaatgctccaccaataatgctaccaccattcttctccagcttccaaactttaccaaatgctgctttcatactaagttttgatgggtcgccagcataaacacctgaacaaaatggttctattaagcgttcaaaaacttcatcac

SEQ ID NO: 708 - DNA, 200 bp, Ambrosia trifida
cctcctcgggacccgagattaccaacaccaaagggccaaactgttggatcttttaggaagggacaagccatgttgcccaatgccatctcaaaacgtttgggtagcagagtgaaagtgtcatggaagctaataaatatctcaaagttggagaatagaggttataatctgacttacgaaacaccaaatggatttgcaagtct

SEQ ID NO: 709 - DNA, 200 bp, Ambrosia trifida
agacttgcaaatccatttggtgtttcgtaagtcagattataacctctattctccaactttgagatatttattagcttccatgacactttcactctgctacccaaacgttttgagatggcattgggcaacatggcttgtcccttcctaaaagatccaacagtttggccctttggtgttggtaatctcgggtcccgaggagg

SEQ ID NO: 710 - DNA, 200 bp, Ambrosia trifida
aaacaccaaatggatttgcaagtctgcaaactaaaactgttgtcatgactgttccttcctacgtggcgagtgacttgttgcgtcctctttcgtcggaagcagcagaggctttgtccaaattttattaccctccagttgctgctgtatctgtttcctatccaaaagaagcgattcgtgctgaccgtttgatcgatggtcaa

SEQ ID NO: 711 - DNA, 200 bp, Ambrosia trifida
ttgaccatcgatcaaacggtcagcacgaatcgcttcttttggataggaaacagatacagcagcaactggagggtaataaaatttggacaaagcctctgctgcttccgacgaaagaggacgcaacaagtcactcgccacgtaggaaggaacagtcatgacaacagttttagtttgcagacttgcaaatccatttggtgttt

SEQ ID NO: 712 - DNA, 200 bp, Ambrosia trifida
tgctgaccgtttgatcgatggtcaacttaagggttttggtcaattacatccaagaagtcaaggcgttgagactttaggtaccatctatagctcatcccttttccctaaccgggcgccacctggaagggttctcctccttaactacattggaggggctacaaatcctggtattttgtcgaagacggagagtgaacttgtgg

SEQ ID NO: 713 - DNA, 200 bp, Ambrosia trifida
ccacaagttcactctccgtcttcgacaaaataccaggatttgtagcccctccaatgtagttaaggaggagaacccttccaggtggcgcccggttagggaaaagggatgagctatagatggtacctaaagtctcaacgccttgacttcttggatgtaattgaccaaaacccttaagttgaccatcgatcaaacggtcagca

SEQ ID NO: 714 - DNA, 200 bp, Ambrosia trifida
tcgaagacggagagtgaacttgtggaagcagttgaccgtgacctaaggaagatgctcataaaccctagagcaggcgaaccgttgactttgggggtcaaagtgtggcctcgagcaatcccacagtttctaattggtcattttgacattttggatgctgcaaaatttgctcttagtgaaggtggatatagaggtatgtttct

SEQ ID NO: 715 - DNA, 200 bp, Ambrosia trifida
agaaacatacctctatatccaccttcactaagagcaaattttgcagcatccaaaatgtcaaaatgaccaattagaaactgtgggattgctcgaggccacactttgacccccaaagtcaacggttcgcctgctctagggtttatgagcatcttccttaggtcacggtcaactgcttccacaagttcactctccgtcttcga

SEQ ID NO: 716 - DNA, 200 bp, Ambrosia trifida
aaggtggatatagaggtatgtttcttggaggcaactatgtttctggtgtggctttaggtcgatgcgtggagagtgcttatgacgttgcagccgatgtaagtacatttttgtcacgaggcgtgtataagtgatactgttatgtagcactttggaatactttcttgtgaggttagtggttacctttttgtcacaaggcaggt

SEQ ID NO: 717 - DNA, 200 bp, Ambrosia trifida
acctgccttgtgacaaaaaggtaaccactaacctcacaagaaagtattccaaagtgctacataacagtatcacttatacacgcctcgtgacaaaaatgtacttacatcggctgcaacgtcataagcactctccacgcatcgacctaaagccacaccagaaacatagttgcctccaagaaacatacctctatatccacctt

SEQ ID NO: 718 - DNA, 200 bp, Ambrosia trifida
ttgcgcctcggttttggacctcgtcgctttagtgcgcttcgcgctttttaaaaccaagcttctatcgagtttaatgactaaaatttagtaaaatataatgaccaatatggaaggtatttcatgacaattaaccctaaatatattaggtaaccacaaaggagggctctctgttgggaaagcaatatcctccggatgcaaag

SEQ ID NO: 719 - DNA, 200 bp, Ambrosia trifida
ctttgcatccggaggatattgctttcccaacagagagccctcctttgtggttacctaatatatttagggttaattgtcatgaaataccttccatattggtcattatattttactaaattttagtcattaaactcgatagaagcttggttttaaaaagcgcgaagcgcactaaagcgacgaggtccaaaaccgaggcgcaa

SEQ ID NO: 720 - DNA, 200 bp, Ambrosia trifida
aaagcaatatcctccggatgcaaagcagccgaatccgtgattgcatatttggattcttattcggaccagaagtagaaggatgggtgttgctagatgatgttttaactggtaaactttatttcttatatcttattttttttcttatttttcaatgcaaagagtcaaacggcgcaagtgtaatatcaggattggccggagaa

SEQ ID NO: 721 - DNA, 200 bp, Ambrosia trifida
ttctccggccaatcctgatattacacttgcgccgtttgactctttgcattgaaaaataagaaaaaaaataagatataagaaataaagtttaccagttaaaacatcatctagcaacacccatccttctacttctggtccgaataagaatccaaatatgcaatcacggattcggctgctttgcatccggaggatattgcttt

SEQ ID NO: 722 - DNA, 200 bp, Ambrosia trifida
tgtaatatcaggattggccggagaatgtagatcaaaagagtttttgttcgctcgaggttggataaatttgacgaaaattcagcatggcttttcgctttgtgtttttgaaggtgagcaaggatggtgttgtataaacttattgttgagtaaattataactaatgacatgtttgaataatgtgttagaaaaaaatgaatctt

SEQ ID NO: 723 - DNA, 200 bp, Ambrosia trifida
aagattcatttttttctaacacattattcaaacatgtcattagttataatttactcaacaataagtttatacaacaccatccttgctcaccttcaaaaacacaaagcgaaaagccatgctgaattttcgtcaaatttatccaacctcgagcgaacaaaaactcttttgatctacattctccggccaatcctgatattaca

SEQ ID NO: 724 - DNA, 200 bp, Ambrosia trifida
aatgtgttagaaaaaaatgaatcttataattgaaaataatatgatcaatttatgatagtgttttcatgttagatataatcaaagtatgaaatcttatatcctaagaatggttatatatggtttagtaggttaagtgtgttttgacaatgatgcataataaggatttaacttggagaaacggtgacgtggacagcttgaag

SEQ ID NO: 725 - DNA, 200 bp, Ambrosia trifida
cttcaagctgtccacgtcaccgtttctccaagttaaatccttattatgcatcattgtcaaaacacacttaacctactaaaccatatataaccattcttaggatataagatttcatactttgattatatctaacatgaaaacactatcataaattgatcatattattttcaattataagattcatttttttctaacacatt

SEQ ID NO: 726 - DNA, 200 bp, Ambrosia trifida
tttctagcaatcttttgatgctgtgatcatgactgccccacttaacaatgtaaaagaaatgaagattacaaagacaggaagtccgtttctgcttaattttattccagaggtgagttatttgccaatatcagtaataatctccactttcaagaaagaaaacgtgaagcagcctcttgagggttttggagttcttgttcctg

SEQ ID NO: 727 - DNA, 200 bp, Ambrosia trifida
caggaacaagaactccaaaaccctcaagaggctgcttcacgttttctttcttgaaagtggagattattactgatattggcaaataactcacctctggaataaaattaagcagaaacggacttcctgtctttgtaatcttcatttcttttacattgttaagtggggcagtcatgatcacagcatcaaaagattgctagaaa

SEQ ID NO: 728 - DNA, 200 bp, Ambrosia trifida
gagggttttggagttcttgttcctgccaaggagcaggaaaatggtttgaggacactaggcaccctcttctcttccatgatgtttccagatcgggcctcagaagacgtgtacctttacaccacctttgttgggggtagtcgaaacaaagaactggccaaagcttcgagggacgagttgaagcagatagtaacttctgacct

SEQ ID NO: 729 - DNA, 200 bp, Ambrosia trifida
aggtcagaagttactatctgcttcaactcgtccctcgaagctttggccagttctttgtttcgactacccccaacaaaggtggtgtaaaggtacacgtcttctgaggcccgatctggaaacatcatggaagagaagagggtgcctagtgtcctcaaaccattttcctgctccttggcaggaacaagaactccaaaaccctc

SEQ ID NO: 730 - DNA, 200 bp, Ambrosia trifida
tgaagcagatagtaacttctgacctcagacagttgcttggaacagaaggggagccaaaatttctaactcactattattggagcaaagcatttccattgtatgggcgtgactatggttcagttattgaagcaattgagaagatggaaaaagagctacccggttacttttatgcaggtaaccacaaaggagggctctctgtt

SEQ ID NO: 731 - DNA, 200 bp, Ambrosia trifida
aacagagagccctcctttgtggttacctgcataaaagtaaccgggtagctctttttccatcttctcaattgcttcaataactgaaccatagtcacgcccatacaatggaaatgctttgctccaataatagtgagttagaaattttggctccccttctgttccaagcaactgtctgaggtcagaagttactatctgcttca

SEQ ID NO: 732 - DNA, 200 bp, Ambrosia trifida
taaccacaaaggagggctctctgttgggaaagcaatatcctccggatgcaaagcagccgaatccgtgattgcatatttggattcttattcggaccagaagtagaaggatgggtgttgctagatgatgttttaactggattggccggagaatgtagatcaaaagagtttttgttcgctagagcgaggataaatttgacgaa

SEQ ID NO: 733 - DNA, 200 bp, Ambrosia trifida
ttcgtcaaatttatcctcgctctagcgaacaaaaactcttttgatctacattctccggccaatccagttaaaacatcatctagcaacacccatccttctacttctggtccgaataagaatccaaatatgcaatcacggattcggctgctttgcatccggaggatattgctttcccaacagagagccctcctttgtggtta

SEQ ID NO: 734 - DNA, 200 bp, Chenopodium album
aaccctcaaaagaaaattttcactgcaatctttgtagccttcttgttagcaaaatactcggacaactaatcctagcaacagcgctatttgtttgagtattgtgagaggtaatccactacctcagctgcagattcataagcaccctctatacatcgccccaatgcaacacctgaaacatagttgccaccaagaaacaatcc

SEQ ID NO: 735 - DNA, 200 bp, Chenopodium album
ggattgtttcttggtggcaactatgtttcaggtgttgcattggggcgatgtatagagggtgcttatgaatctgcagctgaggtagtggattacctctcacaatactcaaacaaatagcgctgttgctaggattagttgtccgagtattttgctaacaagaaggctacaaagattgcagtgaaaattttcttttgagggtt

SEQ ID NO: 736 - DNA, 200 bp, Chenopodium album
catagttgccaccaagaaacaatcccttgaacccagcatcagttagagctgcttttgcagcatcaagcagatcaaagtggccaatcaaaaattgtggaattgcttggggccatactctcacgcccaaaacccggggatcttttgcattaggatttatgagaatgtttctcaagtccttgtcaactgccccagcaagttca

SEQ ID NO: 737 - DNA, 200 bp, Chenopodium album
tgaacttgctggggcagttgacaaggacttgagaaacattctcataaatcctaatgcaaaagatccccgggttttgggcgtgagagtatggccccaagcaattccacaatttttgattggccactttgatctgcttgatgctgcaaaagcagctctaactgatgctgggttcaagggattgtttcttggtggcaactatg

SEQ ID NO: 738 - DNA, 200 bp, Chenopodium album
cttgtcaactgccccagcaagttcatcttgcgtcttgtgtaatatactagtgtttgtagaacctccaatgtaactcaaaattaaggtcctaccaggtggtgctcgaccagggaaaagcgatgaactataaattgatcccaaggtttcaacaccctgactgcggggatgcaattgcccaaatccttgaagtttaccatcaa

SEQ ID NO: 739 - DNA, 200 bp, Chenopodium album
ttgatggtaaacttcaaggatttgggcaattgcatccccgcagtcagggtgttgaaaccttgggatcaatttatagttcatcgcttttccctggtcgagcaccacctggtaggaccttaattttgagttacattggaggttctacaaacactagtatattacacaagacgcaagatgaacttgctggggcagttgacaag

SEQ ID NO: 740 - DNA, 200 bp, Chenopodium album
ccaaatccttgaagtttaccatcaatcaaacactctgatctaattgcttcactaggataagaaagtgacacagctgcaactggtggatagtagaactttgcaagtgattctgcagcaacatctgaaagtggacgaaggaggctacttgcaatatgtgatgggacagtcatcacaacacttttggtccgtacagaaaccag

SEQ ID NO: 741 - DNA, 200 bp, Chenopodium album
ctggtttctgtacggaccaaaagtgttgtgatgactgtcccatcacatattgcaagtagcctccttcgtccactttcagatgttgctgcagaatcacttgcaaagttctactatccaccagttgcagctgtgtcactttcttatcctagtgaagcaattagatcagagtgtttgattgatggtaaacttcaaggatttgg

SEQ ID NO: 742 - DNA, 200 bp, Chenopodium album
cacttttggtccgtacagaaaccagtccatctggtgtttcataagtcagattatattctccatttggcaacttaacaatactagaaagggtccatgatagtttcactttgctgccaagcctttcagaaatggctgtaggcaacatagtgagtcctttcctgaaggatccaactgtctggcccttaggtttagggaggcgc

SEQ ID NO: 743 - DNA, 200 bp, Chenopodium album
gcgcctccctaaacctaagggccagacagttggatccttcaggaaaggactcactatgttgcctacagccatttctgaaaggcttggcagcaaagtgaaactatcatggaccctttctagtattgttaagttgccaaatggagaatataatctgacttatgaaacaccagatggactggtttctgtacggaccaaaagtg

SEQ ID NO: 744 - DNA, 200 bp, Chenopodium album
ctggcccttaggtttagggaggcgcgggtctcgaggtggctttggattgttctttctttcctggattgttttgagggtaccaccaatgatactaccacccttttgttccaagatccaaactttgccaaaagcagctttcatactcaacttggaaggatcgccagcatacacgcctgaacaaaagggttcaatcaagcgtt

SEQ ID NO: 745 - DNA, 200 bp, Chenopodium album
aacgcttgattgaacccttttgttcaggcgtgtatgctggcgatccttccaagttgagtatgaaagctgcttttggcaaagtttggatcttggaacaaaagggtggtagtatcattggtggtaccctcaaaacaatccaggaaagaaagaacaatccaaagccacctcgagacccgcgcctccctaaacctaagggccag

SEQ ID NO: 746 - DNA, 200 bp, Chenopodium album
gaacaaaagggttcaatcaagcgttcaaatacttcatcagcccagattacgacggacaaaatcttcaacagattcctcgtgagctggaggagaaggacgtaagccaagagcaccgagtccagacctaatcttgccagggaagctcataaggtcaaagaaagggaggtcagtgggcttggacggtacaggcctcaatttgc

SEQ ID NO: 747 - DNA, 200 bp, Chenopodium album
gcaaattgaggcctgtaccgtccaagcccactgacctccctttctttgaccttatgagcttccctggcaagattaggtctggactcggtgctcttggcttacgtccttctcctccagctcacgaggaatctgttgaagattttgtccgtcgtaatctgggctgatgaagtatttgaacgcttgattgaacccttttgttc

SEQ ID NO: 748 - DNA, 200 bp, Chenopodium album
ttggacggtacaggcctcaatttgccattccacaacacaaaacgaggggcgttaggatctccaaacaccaattcatctttcaatccactgtcaacagccatggtgagcactgcatcagatggctggaagctgttaggtccctcttcccagatatagccatcggcctccacagtagtgatgtttccaccaactcgatcttt

SEQ ID NO: 749 - DNA, 200 bp, Chenopodium album
aaagatcgagttggtggaaacatcactactgtggaggccgatggctatatctgggaagagggacctaacagcttccagccatctgatgcagtgctcaccatggctgttgacagtggattgaaagatgaattggtgtttggagatcctaacgcccctcgttttgtgttgtggaatggcaaattgaggcctgtaccgtccaa

SEQ ID NO: 750 - DNA, 200 bp, Chenopodium album
tgatgtttccaccaactcgatctttagcctccgtgacaatgaaatttggggagcgggaggagtattttgtagagagagcttgtgcaatgccaagaccactgattccaccacccacaatcacacagtcaagtacttcagcgccatcgattccaacagtagcagtgtttgtgttctggtaattgactgctgaatttgaggtc

SEQ ID NO: 751 - DNA, 200 bp, Chenopodium album
gacctcaaattcagcagtcaattaccagaacacaaacactgctactgttggaatcgatggcgctgaagtacttgactgtgtgattgtgggtggtggaatcagtggtcttggcattgcacaagctctctctacaaaatactcctcccgctccccaaatttcattgtcacggaggctaaagatcgagttggtggaaacatca

SEQ ID NO: 752 - DNA, 200 bp, Commelina diffusa
aattttcttgtgttatgggggaaaaaatctatattgtcataaagagaaaaaaaaattgaatatacaaaccacaacaattagattgctttttccctactatatggggttagctatatgaatcttagtttgcattttttcttatctaaaaaccatttctttagatggccctagataagacagtcaccttttaggacttcgtg

SEQ ID NO: 753 - DNA, 200 bp, Commelina diffusa
cacgaagtcctaaaaggtgactgtcttatctagggccatctaaagaaatggtttttagataagaaaaaatgcaaactaagattcatatagctaaccccatatagtagggaaaaagcaatctaattgttgtggtttgtatattcaatttttttttctctttatgacaatatagattttttcccccataacacaagaaaatt

SEQ ID NO: 754 - DNA, 200 bp, Commelina diffusa
gacagtcaccttttaggacttcgtgaagtgacttttttttttggttatataccatggttgcaagtctcagccaataccaatacgtatcatgtatcgagatcggtagctactgttataggatcgacatagtatcttggattgacatttgcttgttggctggctggccaattttggccagagaatggtaggagttggccggt

SEQ ID NO: 755 - DNA, 200 bp, Commelina diffusa
accggccaactcctaccattctctggccaaaattggccagccagccaacaagcaaatgtcaatccaagatactatgtcgatcctataacagtagctaccgatctcgatacatgatacgtattggtattggctgagacttgcaaccatggtatataaccaaaaaaaaaagtcacttcacgaagtcctaaaaggtgactgtc

SEQ ID NO: 756 - DNA, 200 bp, Commelina diffusa
cagagaatggtaggagttggccggtacgaccgtaacggtgtcaatttcacttggtatcagccaatatcgatcattatgagctctgacaccgttgatattgtattgaaaattaaaatttctattttagaaagttaaatttttattagtttatttatttcttgttaactaatattatcaatattgatacgtatcagatttga

SEQ ID NO: 757 - DNA, 200 bp, Commelina diffusa
tcaaatctgatacgtatcaatattgataatattagttaacaagaaataaataaactaataaaaatttaactttctaaaatagaaattttaattttcaatacaatatcaacggtgtcagagctcataatgatcgatattggctgataccaagtgaaattgacaccgttacggtcgtaccggccaactcctaccattctctg

SEQ ID NO: 758 - DNA, 200 bp, Commelina diffusa
caatattgatacgtatcagatttgaggaaacagatttgcagtcctggtctaaacctctaccctgtgtacgactaccgaaatctagtattgtaacttttctaacaggtgcatctactatctatagaacgtctacaaacacgtacaaactgctgtaaaggattttttcctaaacttgttattaatatgagtcacctatagtt

SEQ ID NO: 759 - DNA, 200 bp, Commelina diffusa
aactataggtgactcatattaataacaagtttaggaaaaaatcctttacagcagtttgtacgtgtttgtagacgttctatagatagtagatgcacctgttagaaaagttacaatactagatttcggtagtcgtacacagggtagaggtttagaccaggactgcaaatctgtttcctcaaatctgatacgtatcaatattg

SEQ ID NO: 760 - DNA, 200 bp, Commelina diffusa
ttattaatatgagtcacctatagttttccttgcacatacttgtttggagttgatctttcctagtgacacctaacttccacctcaacgttcttatctgtgctagacgcactgtttgggtatcttgcttcttaagagcccattattttcataaatcattgtagacctaataccaattttatacaatttacccttagatttaa

SEQ ID NO: 761 - DNA, 200 bp, Commelina diffusa
ttaaatctaagggtaaattgtataaaattggtattaggtctacaatgatttatgaaaataatgggctcttaagaagcaagatacccaaacagtgcgtctagcacagataagaacgttgaggtggaagttaggtgtcactaggaaagatcaactccaaacaagtatgtgcaaggaaaactataggtgactcatattaataa

SEQ ID NO: 762 - DNA, 200 bp, Commelina diffusa
ttatacaatttacccttagatttaagagactctacaatcacataacattcatgaagtttcttgccattttaaccatcttgttttaatgctattaataatatcttctatattttctctattatcttgaataatggacacaagatacataagttttttatttctaaccaactatactccatctaacataacaaattaatttg

SEQ ID NO: 763 - DNA, 200 bp, Commelina diffusa
caaattaatttgttatgttagatggagtatagttggttagaaataaaaaacttatgtatcttgtgtccattattcaagataatagagaaaatatagaagatattattaatagcattaaaacaagatggttaaaatggcaagaaacttcatgaatgttatgtgattgtagagtctcttaaatctaagggtaaattgtataa

SEQ ID NO: 764 - DNA, 200 bp, Commelina diffusa
ccatctaacataacaaattaatttgttcttgtcctactattaatatttcgtttcatatattttgttttaactctacttcatttaaaactaaaattacatgctggaactgaggttctaatcttaagttaacaccttctgctctctcatcatataaaacttctcaacaaaaaatttatgccaaggaatatcattctagatat

SEQ ID NO: 765 - DNA, 200 bp, Commelina diffusa
atatctagaatgatattccttggcataaattttttgttgagaagttttatatgatgagagagcagaaggtgttaacttaagattagaacctcagttccagcatgtaattttagttttaaatgaagtagagttaaaacaaaatatatgaaacgaaatattaatagtaggacaagaacaaattaatttgttatgttagatgg

SEQ ID NO: 766 - DNA, 200 bp, Commelina diffusa
tgccaaggaatatcattctagatatgccaaagtcaatagaagatatgaatttaaagaaccttggtggactcctattgtgataggagatctattgaactttcttacttatttttaattatgtcttatatctactagaaaccatttgcttttctaagatctaccaaagaacatccataggtattctatcatatgcattttct

SEQ ID NO: 767 - DNA, 200 bp, Commelina diffusa
agaaaatgcatatgatagaatacctatggatgttctttggtagatcttagaaaagcaaatggtttctagtagatataagacataattaaaaataagtaagaaagttcaatagatctcctatcacaataggagtccaccaaggttctttaaattcatatcttctattgactttggcatatctagaatgatattccttggca

SEQ ID NO: 768 - DNA, 200 bp, Commelina diffusa
aggtattctatcatatgcattttctgagtcaataagaaccatatacatgtctttgttcctatttctaagcgtttgtactaattgccttgataaactgatagtggtaggtataaatccaaaatgattattagaaatattagtttcacatcttagtcgttgttctgtcactattcttttcctactttcatcttcctaagagc

SEQ ID NO: 769 - DNA, 200 bp, Commelina diffusa
gctcttaggaagatgaaagtaggaaaagaatagtgacagaacaacgactaagatgtgaaactaatatttctaataatcattttggatttatacctaccactatcagtttatcaaggcaattagtacaaacgcttagaaataggaacaaagacatgtatatggttcttattgactcagaaaatgcatatgatagaatacct

SEQ ID NO: 770 - DNA, 200 bp, Commelina diffusa
ttcctactttcatcttcctaagagcatcttttacttcacaagtcctgatgttttgaatataagtagttctttttttttttaattagtggaatttacctgtaaaactatgtctagcaaggctctctccaagtgtaactttataatcctcataaatcctctgatcaccatttctagtgagaaaaggaaatcaatttggcccc

SEQ ID NO: 771 - DNA, 200 bp, Commelina diffusa
ggggccaaattgatttccttttctcactagaaatggtgatcagaggatttatgaggattataaagttacacttggagagagccttgctagacatagttttacaggtaaattccactaattaaaaaaaaaaagaactacttatattcaaaacatcaggacttgtgaagtaaaagatgctcttaggaagatgaaagtaggaa

SEQ ID NO: 772 - DNA, 200 bp, Commelina diffusa
gagaaaaggaaatcaatttggcccctactagaactatccttaaaagtaattaaatgacagtctctctttccatatagaataatgattaccaccgtattgtacgataaagcagattctaaaattttgacctttacattattcatctccccatacccataatcaccacaagtaaacttaattttcctactatcttttgccta

SEQ ID NO: 773 - DNA, 200 bp, Commelina diffusa
taggcaaaagatagtaggaaaattaagtttacttgtggtgattatgggtatggggagatgaataatgtaaaggtcaaaattttagaatctgctttatcgtacaatacggtggtaatcattattctatatggaaagagagactgtcatttaattacttttaaggatagttctagtaggggccaaattgatttccttttctc

SEQ ID NO: 774 - DNA, 200 bp, Commelina diffusa
taattttcctactatcttttgcctacgtgtcatggatgagtaccaggggaggaggagaggacaggggaaaaaggaacaaaatggaatcaaaataaaataaaatgctcatgccaacaataatgtggctaaaatcggacggaaaactaccgatggaagtttttgcagcatttaatgaaatgttaagtgtatttgctatttca

SEQ ID NO: 775 - DNA, 200 bp, Commelina diffusa
tgaaatagcaaatacacttaacatttcattaaatgctgcaaaaacttccatcggtagttttccgtccgattttagccacattattgttggcatgagcattttattttattttgattccattttgttcctttttcccctgtcctctcctcctcccctggtactcatccatgacacgtaggcaaaagatagtaggaaaatta

SEQ ID NO: 776 - DNA, 200 bp, Commelina diffusa
aatgttaagtgtatttgctatttcaaaaaaactcaattattttttattgttttggcaaaggtttagattttatctgcatttaactcttataaaacattatgaaatgatatttgttatcgactttcttgcactttcatgtgctaagcgtgtcacaactgctgaatgctactatgcaggaacaatatatagctcatcccttt

SEQ ID NO: 777 - DNA, 200 bp, Commelina diffusa
aaagggatgagctatatattgttcctgcatagtagcattcagcagttgtgacacgcttagcacatgaaagtgcaagaaagtcgataacaaatatcatttcataatgttttataagagttaaatgcagataaaatctaaacctttgccaaaacaataaaaaataattgagtttttttgaaatagcaaatacacttaacatt

SEQ ID NO: 778 - DNA, 200 bp, Commelina diffusa
ggaacaatatatagctcatccctttttcctggccgagctccccaagggagaatattgcttcttaactacattggaggtgctacaaatactggaattgtatcaaaggtgttggaacttgaccatttttcagtttttgtgaagttgcaaaaagttatatcctctacgaaaacatatgcagcttaggctatccataatatata

SEQ ID NO: 779 - DNA, 200 bp, Commelina diffusa
tatatattatggatagcctaagctgcatatgttttcgtagaggatataactttttgcaacttcacaaaaactgaaaaatggtcaagttccaacacctttgatacaattccagtatttgtagcacctccaatgtagttaagaagcaatattctcccttggggagctcggccaggaaaaagggatgagctatatattgttcc

SEQ ID NO: 780 - DNA, 200 bp, Commelina diffusa
cagcttaggctatccataatatataatccatttttaattagtgaaaacatatttcctaggaaacctcaattaaaatgtcatccattatgtctacaattgatactttattttgtttgctcttcttttccagacagtttttctagcatttacaccatgttgccactaggaatattgagtttggactggtttttccattcatt

SEQ ID NO: 781 - DNA, 200 bp, Commelina diffusa
aatgaatggaaaaaccagtccaaactcaatattcctagtggcaacatggtgtaaatgctagaaaaactgtctggaaaagaagagcaaacaaaataaagtatcaattgtagacataatggatgacattttaattgaggtttcctaggaaatatgttttcactaattaaaaatggattatatattatggatagcctaagctg

SEQ ID NO: 782 - DNA, 200 bp, Commelina diffusa
gtttggactggtttttccattcattggctaaaattttgtctatttcatttaaacatggagaggatgttgcaaacaccttctagatgtttgaattatcaaatcgttcataaagattttaagtcccaactaatatatgatgctgatttttcaagttttttttatgtgcagaatgagagcgaactggtagaagcagttgatcg

SEQ ID NO: 783 - DNA, 200 bp, Commelina diffusa
cgatcaactgcttctaccagttcgctctcattctgcacataaaaaaaacttgaaaaatcagcatcatatattagttgggacttaaaatctttatgaacgatttgataattcaaacatctagaaggtgtttgcaacatcctctccatgtttaaatgaaatagacaaaattttagccaatgaatggaaaaaccagtccaaac

SEQ ID NO: 784 - DNA, 200 bp, Commelina diffusa
gcgaactggtagaagcagttgatcgtgaccttagaaagatgctgataaagccaactgctgaggatcctcttcttgttggtgtaagagtatggccacaagctataccccagttcctggttggtcatcttgaccatctcgaggcagctaatgaagccctcaggaaaggaggttttggtggattttttcttggtggcaactat

SEQ ID NO: 785 - DNA, 200 bp, Commelina diffusa
atagttgccaccaagaaaaaatccaccaaaacctcctttcctgagggcttcattagctgcctcgagatggtcaagatgaccaaccaggaactggggtatagcttgtggccatactcttacaccaacaagaagaggatcctcagcagttggctttatcagcatctttctaaggtcacgatcaactgcttctaccagttcgc

SEQ ID NO: 786 - DNA, 200 bp, Commelina diffusa
ccatgctctaatagcttgtccgtcgtaatcttgggaatgaggtttttgaacgattgattgagccattctgttcaggtgcgcacaattcaattttcgctatgataagcaaaaaggtttttcacatgataattacctttgtttttttcttttggtgattaacatgcttttgtttgtaatgtcatatatatactatgttttac

SEQ ID NO: 787 - DNA, 200 bp, Commelina diffusa
gtaaaacatagtatatatatgacattacaaacaaaagcatgttaatcaccaaaagaaaaaaacaaaggtaattatcatgtgaaaaacctttttgcttatcatagcgaaaattgaattgtgcgcacctgaacagaatggctcaatcaatcgttcaaaaacctcattcccaagattacgacggacaagctattagagcatgg

SEQ ID NO: 788 - DNA, 200 bp, Commelina diffusa
atgtcatatatatactatgttttacctagatatttgttttgaatttttttttcttctggatttttagttttctgcgttctttactccaaattgaatcagtttgtcataactgttatggcaattgttttgatcatgtttttaaaggagtctccctgttttatcatctagcttaggagtaccaaaatgagcatttatgttct

SEQ ID NO: 789 - DNA, 200 bp, Commelina diffusa
agaacataaatgctcattttggtactcctaagctagatgataaaacagggagactcctttaaaaacatgatcaaaacaattgccataacagttatgacaaactgattcaatttggagtaaagaacgcagaaaactaaaaatccagaagaaaaaaaaattcaaaacaaatatctaggtaaaacatagtatatatatgacat

SEQ ID NO: 790 - DNA, 200 bp, Commelina diffusa
gtaccaaaatgagcatttatgttctctagaagttataggataagaaagacaggtgagaccttctggactgatttcacctaaaaaaatgctaaatctgcaggggtatatgctggagatcctacaaaacttagtatgaaggcagcttttggtaaagtatggaagttagaacagactggtggaagtattattgggggcactat

SEQ ID NO: 791 - DNA, 200 bp, Commelina diffusa
atagtgcccccaataatacttccaccagtctgttctaacttccatactttaccaaaagctgccttcatactaagttttgtaggatctccagcatatacccctgcagatttagcatttttttaggtgaaatcagtccagaaggtctcacctgtctttcttatcctataacttctagagaacataaatgctcattttggtac

SEQ ID NO: 792 - DNA, 200 bp, Commelina diffusa
gtggaagtattattgggggcactattaagacaatccaagatcaaaagaaaaatcccaaacctcctagagatccgtaagaatttcatgaaccaaattgggtttccatactacctgattgaaagtaatgaagtatccttgagttaattgttgctatttatcagacgcctaccaacaccaaaaggacaaacagttgcatcttt

SEQ ID NO: 793 - DNA, 200 bp, Commelina diffusa
aaagatgcaactgtttgtccttttggtgttggtaggcgtctgataaatagcaacaattaactcaaggatacttcattactttcaatcaggtagtatggaaacccaatttggttcatgaaattcttacggatctctaggaggtttgggatttttcttttgatcttggattgtcttaatagtgcccccaataatacttccac

SEQ ID NO: 794 - DNA, 200 bp, Commelina diffusa
caaaaggacaaacagttgcatcttttaggaaagggcttaacatgctacctgcagcaatttcttccaggtctttgttttttttcattctttgtaataccctgtaactatctgcaggcttttacaaactggttatactttttttttactttaccaagttggttagttagtagttatatttatgtgttcatactgaagatgag

SEQ ID NO: 795 - DNA, 200 bp, Commelina diffusa
ctcatcttcagtatgaacacataaatataactactaactaaccaacttggtaaagtaaaaaaaaagtataaccagtttgtaaaagcctgcagatagttacagggtattacaaagaatgaaaaaaaacaaagacctggaagaaattgctgcaggtagcatgttaagccctttcctaaaagatgcaactgtttgtccttttg

SEQ ID NO: 796 - DNA, 200 bp, Commelina diffusa
tttatgtgttcatactgaagatgagcaacttctgttttttatcataattatatttatatatttcttttgttatctatcaaggattatccttcagatctaacagttcacaaacttcactagcttgtatcttggaacatattttctttactttaatattttcattgacttgtatttcgtggaaaaacagactgggtagcaaa

SEQ ID NO: 797 - DNA, 200 bp, Commelina diffusa
tttgctacccagtctgtttttccacgaaatacaagtcaatgaaaatattaaagtaaagaaaatatgttccaagatacaagctagtgaagtttgtgaactgttagatctgaaggataatccttgatagataacaaaagaaatatataaatataattatgataaaaaacagaagttgctcatcttcagtatgaacacataaa

SEQ ID NO: 798 - DNA, 200 bp, Commelina diffusa
gtggaaaaacagactgggtagcaaagtgaaactatcatggaaacttgtgagcatcaggaagctggagagccaggaatatttattgctatatgaaacatcagaaggattgacttcagtacagactagaagtgttgttctgactgttccatcttatattgccagcaatctccttcgctctctttcagtaagcttatgcccca

SEQ ID NO: 799 - DNA, 200 bp, Commelina diffusa
tggggcataagcttactgaaagagagcgaaggagattgctggcaatataagatggaacagtcagaacaacacttctagtctgtactgaagtcaatccttctgatgtttcatatagcaataaatattcctggctctccagcttcctgatgctcacaagtttccatgatagtttcactttgctacccagtctgtttttccac

SEQ ID NO: 800 - DNA, 200 bp, Commelina diffusa
tctctttcagtaagcttatgccccactttaagcttctacagtccctttgaatatgtttatggaattctgttataaagaccttctcggttgctttttctgtagttaatttatgtggatggagaatctttctagaaattgttgacatgatactatatatggtatctatattgtgtgacatgttattgttgaccaatatatgc

SEQ ID NO: 801 - DNA, 200 bp, Commelina diffusa
gcatatattggtcaacaataacatgtcacacaatatagataccatatatagtatcatgtcaacaatttctagaaagattctccatccacataaattaactacagaaaaagcaaccgagaaggtctttataacagaattccataaacatattcaaagggactgtagaagcttaaagtggggcataagcttactgaaagaga

SEQ ID NO: 802 - DNA, 200 bp, Commelina diffusa
gctatatgaaacatcagaaggattgacttcagtacagactagaagtgttgttctgactgttccatcttatattgccagcaatctccttcgctctctttcaaatgacgcagctgatgctttgtcaaagttttactatcctccagttgctgctgtttccatttcatatccaaaggaagctattaggaacgaatgtttaatcg

SEQ ID NO: 803 - DNA, 200 bp, Commelina diffusa
cgattaaacattcgttcctaatagcttcctttggatatgaaatggaaacagcagcaactggaggatagtaaaactttgacaaagcatcagctgcgtcatttgaaagagagcgaaggagattgctggcaatataagatggaacagtcagaacaacacttctagtctgtactgaagtcaatccttctgatgtttcatatagc

SEQ ID NO: 804 - DNA, 200 bp, Commelina diffusa
gctattaggaacgaatgtttaatcgatggtgagcttaagggatttggccagttgcatccacgtagtcaaggagtagagacactcggaacaatatatagctcatcccttttcctggccgagctccccaagggagaatattgcttcttaactacattggaggtgctacaaatactggaattgtatcaaagaatgagagcgaa

SEQ ID NO: 805 - DNA, 200 bp, Commelina diffusa
ttcgctctcattctttgatacaattccagtatttgtagcacctccaatgtagttaagaagcaatattctcccttggggagctcggccaggaaaagggatgagctatatattgttccgagtgtctctactccttgactacgtggatgcaactggccaaatcccttaagctcaccatcgattaaacattcgttcctaatagc

SEQ ID NO: 806 - DNA, 200 bp, Commelina diffusa
ttatgattaaagatatatatatccaattagtttacttccacattgcataatgtaccttgatatatatttcctactagcattttttccttaaaattacgatttttgtatgattatcagattaacaacactagcggcctcttttatattgatcctagtggaaggaggatattcctcctaatttgttgtactaagacatcggc

SEQ ID NO: 807 - DNA, 200 bp, Commelina diffusa
gccgatgtcttagtacaacaaattaggaggaatatcctccttccactaggatcaatataaaagaggccgctagtgttgttaatctgataatcatacaaaaatcgtaattttaaggaaaaaatgctagtaggaaatatatatcaaggtacattatgcaatgtggaagtaaactaattggatatatatatctttaatcataa

SEQ ID NO: 808 - DNA, 200 bp, Commelina diffusa
taatttgttgtactaagacatcggctacatttttttttttgcttatggagacatctatattaatatttgtggttcacatgattcttgttgcttaaagattatttaatggatggtggttgcagaatgacgcagctgatgctttgtcaaagttttactatcctccagttgctgctgtttccatttcatatccaaaggaagct

SEQ ID NO: 809 - DNA, 200 bp, Commelina diffusa
agcttcctttggatatgaaatggaaacagcagcaactggaggatagtaaaactttgacaaagcatcagctgcgtcattctgcaaccaccatccattaaataatctttaagcaacaagaatcatgtgaaccacaaatattaatatagatgtctccataagcaaaaaaaaaaatgtagccgatgtcttagtacaacaaatta

SEQ ID NO: 810 - DNA, 200 bp, Commelina diffusa
ttccatttcatatccaaaggaagctattaggaacgaatgtttaatcgatggtgagcttaagggatttggccagttgcatccacgtagtcaaggagtagagacactcggtactgttctgtcttgtttatggccccacactactcaccccaaatataatataggttctatatgtatatgctctctggatttccatttgcaat

SEQ ID NO: 811 - DNA, 200 bp, Commelina diffusa
attgcaaatggaaatccagagagcatatacatatagaacctatattatatttggggtgagtagtgtggggccataaacaagacagaacagtaccgagtgtctctactccttgactacgtggatgcaactggccaaatcccttaagctcaccatcgattaaacattcgttcctaatagcttcctttggatatgaaatggaa

SEQ ID NO: 812 - DNA, 200 bp, Conyza canadensis
aaaagtatatttaaaattttttgcccacaccaaaaaaaattttaaaaaaaagaagtacatatgcaatcaatgacatgcgatttcaatcccaactttcaaatctcaatttttaaatgctagtagctataagtaaataatctccattctccttctctatacatcttttcttattcaacaggtaatactttcatttattaatc

SEQ ID NO: 813 - DNA, 200 bp, Conyza canadensis
gattaataaatgaaagtattacctgttgaataagaaaagatgtatagagaaggagaatggagattatttacttatagctactagcatttaaaaattgagatttgaaagttgggattgaaatcgcatgtcattgattgcatatgtacttcttttttttaaaattttttttggtgtgggcaaaaaattttaaatatactttt

SEQ ID NO: 814 - DNA, 200 bp, Conyza canadensis
caggtaatactttcatttattaatcataaaattatacatatatattttccctaatttttaggtttcttaatttcttttgacgtgaattgaaagatgaaaacgtgatgatagattggaagagttgaagaggggttttgttttggggaatctcatacataacacactaaacaacatattatcagttatcttgtattgattta

SEQ ID NO: 815 - DNA, 200 bp, Conyza canadensis
taaatcaatacaagataactgataatatgttgtttagtgtgttatgtatgagattccccaaaacaaaacccctcttcaactcttccaatctatcatcacgttttcatctttcaattcacgtcaaaagaaattaagaaacctaaaaattagggaaaatatatatgtataattttatgattaataaatgaaagtattacctg

SEQ ID NO: 816 - DNA, 200 bp, Conyza canadensis
ttatcagttatcttgtattgatttaatataaaatatgagtactaaaataccattatatggatcgtataagtttagtgaatagttcgtgcttttggttatacgacgaaattgtagttggtttattatatcgtcttttgagtttgcattttggttgtaattggatggttattattttgtgggtatatgaatttattggaatt

SEQ ID NO: 817 - DNA, 200 bp, Conyza canadensis
aattccaataaattcatatacccacaaaataataaccatccaattacaaccaaaatgcaaactcaaaagacgatataataaaccaactacaatttcgtcgtataaccaaaagcacgaactattcactaaacttatacgatccatataatggtattttagtactcatattttatattaaatcaatacaagataactgataa

SEQ ID NO: 818 - DNA, 200 bp, Conyza canadensis
gtgggtatatgaatttattggaatttgatcgatatattaaaatttttgtacctatataatgttttaaatttgtcaccttacgataaagttcctggctccgccttgatagcagccttcatgtaaaattggttttcataaacgttctgagtttttataaattttgtaacatgtcattcttctggaaatatgcttctcttcaa

SEQ ID NO: 819 - DNA, 200 bp, Conyza canadensis
ttgaagagaagcatatttccagaagaatgacatgttacaaaatttataaaaactcagaacgtttatgaaaaccaattttacatgaaggctgctatcaaggcggagccaggaactttatcgtaaggtgacaaatttaaaacattatataggtacaaaaattttaatatatcgatcaaattccaataaattcatatacccac

SEQ ID NO: 820 - DNA, 200 bp, Conyza canadensis
cttctggaaatatgcttctcttcaatttaacgcgtatatgagcgttgcattcgcatataatcgaatgtctcgtggaaagtactaaagacttggccaacgttaggtttcattatcatcttctaggggattgtttaagtccaacataattaagaatttacaaacagaaggaacaacgtaggaaaagtcataatcaattgaat

SEQ ID NO: 821 - DNA, 200 bp, Conyza canadensis
attcaattgattatgacttttcctacgttgttccttctgtttgtaaattcttaattatgttggacttaaacaatcccctagaagatgataatgaaacctaacgttggccaagtctttagtactttccacgagacattcgattatatgcgaatgcaacgctcatatacgcgttaaattgaagagaagcatatttccagaag

SEQ ID NO: 822 - DNA, 200 bp, Conyza canadensis
taggaaaagtcataatcaattgaatagtttgattagtcaatttatcagtacttaaactaagatatagtaagatgaggttgaaaaacaactactataacatacaaacatatatggatcttccttaaataataacaatgttaaagattactgcaaaaattacagaccttcattttcagcaatgatggtatgaagttgaaata

SEQ ID NO: 823 - DNA, 200 bp, Conyza canadensis
tatttcaacttcataccatcattgctgaaaatgaaggtctgtaatttttgcagtaatctttaacattgttattatttaaggaagatccatatatgtttgtatgttatagtagttgtttttcaacctcatcttactatatcttagtttaagtactgataaattgactaatcaaactattcaattgattatgacttttccta

SEQ ID NO: 824 - DNA, 200 bp, Conyza canadensis
gcaatgatggtatgaagttgaaataatcgtttgttgttttcaattaacattttttcacaaagggagagagataaatatggtgatcagctttatatttcaatataatgtgaaaggtctgaaaaaaaaatttgaccaagtgtaaaaaatatgttttggataaataaaagttaatttaaataatctactaaaattagcccctg

SEQ ID NO: 825 - DNA, 200 bp, Conyza canadensis
caggggctaattttagtagattatttaaattaacttttatttatccaaaacatattttttacacttggtcaaatttttttttcagacctttcacattatattgaaatataaagctgatcaccatatttatctctctccctttgtgaaaaaatgttaattgaaaacaacaaacgattatttcaacttcataccatcattgc

SEQ ID NO: 826 - DNA, 200 bp, Conyza canadensis
aataatctactaaaattagcccctggtttacaaatatcatttcacttataatttattaaccataatttactaatttgttcagtcaaacttttttttttatatagtttctttatttaacgtactcacaacacattacaatctctcatattgggtatttttactgctgcattacgtgagtttttttttattgtatcatataa

SEQ ID NO: 827 - DNA, 200 bp, Conyza canadensis
ttatatgatacaataaaaaaaaactcacgtaatgcagcagtaaaaatacccaatatgagagattgtaatgtgttgtgagtacgttaaataaagaaactatataaaaaaaaaagtttgactgaacaaattagtaaattatggttaataaattataagtgaaatgatatttgtaaaccaggggctaattttagtagattatt

SEQ ID NO: 828 - DNA, 200 bp, Conyza canadensis
agtttttttttattgtatcatataatttttgacaaatgatttttaataaaacaaaccttttcactctttaatggtgaggtttcaattccacagtttaatcaattgccgatcgatgtatatatgtaatttttagttttaatttagtaaatacaaaattatttaactagggtataggaagagtagacttgaaaatatgggtg

SEQ ID NO: 829 - DNA, 200 bp, Conyza canadensis
cacccatattttcaagtctactcttcctataccctagttaaataattttgtatttactaaattaaaactaaaaattacatatatacatcgatcggcaattgattaaactgtggaattgaaacctcaccattaaagagtgaaaaggtttgttttattaaaaatcatttgtcaaaaattatatgatacaataaaaaaaaact

SEQ ID NO: 830 - DNA, 200 bp, Conyza canadensis
aagagtagacttgaaaatatgggtgataatttcttgattctttcaatttgagtaagttaaagaaatcttaactcttcaaattttggcctttaatttatatctaaaggttaatttttatctaaaggttaacattactataacttggactaattccctccctaaaaatatatacccattttccttatctgacttggaaaata

SEQ ID NO: 831 - DNA, 200 bp, Conyza canadensis
tattttccaagtcagataaggaaaatgggtatatatttttagggagggaattagtccaagttatagtaatgttaacctttagataaaaattaacctttagatataaattaaaggccaaaatttgaagagttaagatttctttaacttactcaaattgaaagaatcaagaaattatcacccatattttcaagtctactctt

SEQ ID NO: 832 - DNA, 200 bp, Conyza canadensis
ttttccttatctgacttggaaaatagtggggtagatcggatctgacctaacctgatttgacccgatccgacccgaacgttgaaaatgaaaattagtttactagaggtggttcacccacagagaaattataccaaaccgaaacaacccaacaatggcttctccaacaacaacaacagatgataacaaaggtagatactatt

SEQ ID NO: 833 - DNA, 200 bp, Conyza canadensis
aatagtatctacctttgttatcatctgttgttgttgttggagaagccattgttgggttgtttcggtttggtataatttctctgtgggtgaaccacctctagtaaactaattttcattttcaacgttcgggtcggatcgggtcaaatcaggttaggtcagatccgatctaccccactattttccaagtcagataaggaaaa

SEQ ID NO: 834 - DNA, 200 bp, Conyza canadensis
gatgataacaaaggtagatactatttctttttcttcttaataatcttaatatgttattattttcattgtagataatccagttctgcattttgttgcacagagaaagcacctgctaagagagttgcagttgttggcgccggtgtcaggtcaatgttactactttcatatatataatatatgtatcttgcgttttattttac

SEQ ID NO: 835 - DNA, 200 bp, Conyza canadensis
gtaaaataaaacgcaagatacatatattatatatatgaaagtagtaacattgacctgacaccggcgccaacaactgcaactctcttagcaggtgctttctctgtgcaacaaaatgcagaactggattatctacaatgaaaataataacatattaagattattaagaagaaaaagaaatagtatctacctttgttatcatc

SEQ ID NO: 836 - DNA, 200 bp, Conyza canadensis
atatgtatcttgcgttttattttacttcttactttttacggcgaaatacccaaatatcccaccccacggaaggttatgtagactttggttttctttgacctctatagttggttacttgttatggccatgaaatgaaagattcctaaacgagggtggagattactctagcgtttgttttgaccccaaaaatgctttgcttg

SEQ ID NO: 837 - DNA, 200 bp, Conyza canadensis
caagcaaagcatttttggggtcaaaacaaacgctagagtaatctccaccctcgtttaggaatctttcatttcatggccataacaagtaaccaactatagaggtcaaagaaaaccaaagtctacataaccttccgtggggtgggatatttgggtatttcgccgtaaaaagtaagaagtaaaataaaacgcaagatacatat

SEQ ID NO: 838 - DNA, 200 bp, Conyza canadensis
tttgaccccaaaaatgctttgcttgtcggaggacatgaccaatatttagaggactaggattagcttagcggaatatggtagataagtaatccttttaggggtactttatataattgtggattttcatgcatgatacctttcttatatgctcatatgacttctttgcactgttaggggtagtgttcttgacagctaggtga

SEQ ID NO: 839 - DNA, 200 bp, Conyza canadensis
tcacctagctgtcaagaacactacccctaacagtgcaaagaagtcatatgagcatataagaaaggtatcatgcatgaaaatccacaattatataaagtacccctaaaaggattacttatctaccatattccgctaagctaatcctagtcctctaaatattggtcatgtcctccgacaagcaaagcatttttggggtcaaa

SEQ ID NO: 840 - DNA, 200 bp, Conyza canadensis
ggtagtgttcttgacagctaggtgacctatgctactttgtttcataggtcgattagggattagcacccactatttttttatttttttggaaggcattaaattatattatattaaagataaaaattgccagtaagaaactagccgatacatagactgtccaatccaaaatagaaaactagcacccacattatatgtgggcc

SEQ ID NO: 841 - DNA, 200 bp, Conyza canadensis
ggcccacatataatgtgggtgctagttttctattttggattggacagtctatgtatcggctagtttcttactggcaatttttatctttaatataatataatttaatgccttccaaaaaaataaaaaaatagtgggtgctaatccctaatcgacctatgaaacaaagtagcataggtcacctagctgtcaagaacactacc

SEQ ID NO: 842 - DNA, 200 bp, Conyza canadensis
ctagcacccacattatatgtgggcccaccggtccctaggacttcctagtaaatatctacttatatctatgtatgcatggctgataccaaccctatttgcttttgtgacttgctgggaggaggttaaaggggttcttgacttcttgcacatgccactcgtactaccaaacctatttgcttctatgacttgctgggaggaga

SEQ ID NO: 843 - DNA, 200 bp, Conyza canadensis
tctcctcccagcaagtcatagaagcaaataggtttggtagtacgagtggcatgtgcaagaagtcaagaacccctttaacctcctcccagcaagtcacaaaagcaaatagggttggtatcagccatgcatacatagatataagtagatatttactaggaagtcctagggaccggtgggcccacatataatgtgggtgctag

SEQ ID NO: 844 - DNA, 200 bp, Conyza canadensis
gcttctatgacttgctgggaggagacatgcccctattaattgttgctctcatcccacatgtttggttctatgcagacggttatatttattatgtttttatgatgtttaatatgttcaaatgtcttatttactatgtattgtccaatttgggctatgtggtatgtcttctacccttgtctactcttaatgtagtaagagta

SEQ ID NO: 845 - DNA, 200 bp, Conyza canadensis
tactcttactacattaagagtagacaagggtagaagacataccacatagcccaaattggacaatacatagtaaataagacatttgaacatattaaacatcataaaaacataataaatataaccgtctgcatagaaccaaacatgtgggatgagagcaacaattaataggggcatgtctcctcccagcaagtcatagaagc

SEQ ID NO: 846 - DNA, 200 bp, Conyza canadensis
gtctactcttaatgtagtaagagtatcatcatactcgatcgacaggtatggttactgaactctttacactctcctacttttgccttttttggatggaggtccttatggaagtagtctttctgcctctgggtagaggcaagactgtctacatctcacatcccccatacccctcgcacaagaattgggtcatgttgtttttg

SEQ ID NO: 847 - DNA, 200 bp, Conyza canadensis
caaaaacaacatgacccaattcttgtgcgaggggtatgggggatgtgagatgtagacagtcttgcctctacccagaggcagaaagactacttccataaggacctccatccaaaaaaggcaaaagtaggagagtgtaaagagttcagtaaccatacctgtcgatcgagtatgatgatactcttactacattaagagtagac

SEQ ID NO: 848 - DNA, 200 bp, Conyza canadensis
caagaattgggtcatgttgtttttgtggactcgaacccagatggtaagatgtttccaatggggtttacatattgttgattttttgctgctagtataatatattattttgattattcgttacatgtatgaaatttgtaaataaattggtgagtatagtagtctagtgcaacatggtgattgattgatatctagaggaatgg

SEQ ID NO: 849 - DNA, 200 bp, Conyza canadensis
ccattcctctagatatcaatcaatcaccatgttgcactagactactatactcaccaatttatttacaaatttcatacatgtaacgaataatcaaaataatatattatactagcagcaaaaaatcaacaatatgtaaaccccattggaaacatcttaccatctgggttcgagtccacaaaaacaacatgacccaattcttg

SEQ ID NO: 850 - DNA, 200 bp, Conyza canadensis
gattgattgatatctagaggaatggctggccatattatgttgaatcatgaatgaatgacttggtttgtttcagtgggcttgcggctgcatataagttaaaactacatggaataaatgtcactgtttttgaagccggtgagatagccggagggaaactaagaagcatttcacaaaacggtttaatatgggacgagggtgcc

SEQ ID NO: 851 - DNA, 200 bp, Conyza canadensis
ggcaccctcgtcccatattaaaccgttttgtgaaatgcttcttagtttccctccggctatctcaccggcttcaaaaacagtgacatttattccatgtagttttaacttatatgcagccgcaagcccactgaaacaaaccaagtcattcattcatgattcaacataatatggccagccattcctctagatatcaatcaatc

SEQ ID NO: 852 - DNA, 200 bp, Conyza canadensis
cggtttaatatgggacgagggtgccaatactatggtatgatatcgatgttagtttgcttatagacataacttctttttttttattttttttaaaaaaaagttgttttgatgctcttttactccgtatttgtagactgagagtgaaccggatgtcagcaggttgcttgatgatcttggtcttcgagataaacaacagtctg

SEQ ID NO: 853 - DNA, 200 bp, Conyza canadensis
cagactgttgtttatctcgaagaccaagatcatcaagcaacctgctgacatccggttcactctcagtctacaaatacggagtaaaagagcatcaaaacaacttttttttaaaaaaaataaaaaaaaagaagttatgtctataagcaaactaacatcgatatcataccatagtattggcaccctcgtcccatattaaaccg

SEQ ID NO: 854 - DNA, 200 bp, Conyza canadensis
ggtcttcgagataaacaacagtctgtaagttatatgctgttggatatggaacatcatgcttcctgtagcgtgcgtttgaaaatttatttttgcaaatttctcccattgtatactaaatgacatagtataaagaagaggaaattgtttatatcacttttattcgtgttcaaatacggaaggctaaatccactttatgtggc

SEQ ID NO: 855 - DNA, 200 bp, Conyza canadensis
gccacataaagtggatttagccttccgtatttgaacacgaataaaagtgatataaacaatttcctcttctttatactatgtcatttagtatacaatgggagaaatttgcaaaaataaattttcaaacgcacgctacaggaagcatgatgttccatatccaacagcatataacttacagactgttgtttatctcgaagacc

SEQ ID NO: 856 - DNA, 200 bp, Conyza canadensis
gaaggctaaatccactttatgtggctgtggctgtaataatttgtcggctatggttcttgtttcatttatttgttgtggtcatgtgtgtatatgtttaccatggctgaatactacactatatttccttttgcagccactttcccaacataagcgatatattgtaagaaatggaaaaccggtactggtatgatatctcaaca

SEQ ID NO: 857 - DNA, 200 bp, Conyza canadensis
tgttgagatatcataccagtaccggttttccatttcttacaatatatcgcttatgttgggaaagtggctgcaaaaggaaatatagtgtagtattcagccatggtaaacatatacacacatgaccacaacaaataaatgaaacaagaaccatagccgacaaattattacagccacagccacataaagtggatttagccttc

SEQ ID NO: 858 - DNA, 200 bp, Conyza canadensis
ccggtactggtatgatatctcaacaccatgctgaaaactaatcctctgttatatatgaacaaaagagtttaaaagtataagatgaaactttacttcaaaatcattagtagaaattgtgttttattggactcaaattctcaacctcataaacacttgtcatttgtttacaaagttttgtaaactgattttttgttttctgg

SEQ ID NO: 859 - DNA, 200 bp, Conyza canadensis
ccagaaaacaaaaaatcagtttacaaaactttgtaaacaaatgacaagtgtttatgaggttgagaatttgagtccaataaaacacaatttctactaatgattttgaagtaaagtttcatcttatacttttaaactcttttgttcatatataacagaggattagttttcagcatggtgttgagatatcataccagtaccgg

SEQ ID NO: 860 - DNA, 200 bp, Conyza canadensis
tgtaaactgattttttgttttctgggaatgtaaataattatggcagtttattgtactgttctttcgtatagatagttataaactcaaaacacaaaaaaaaggttgttttattacgcggtcgtagctgtcacaattttagttttcttttgtacttgccaagttcatgtcttatatactgaatgtaacttggccaaactcat

SEQ ID NO: 861 - DNA, 200 bp, Conyza canadensis
atgagtttggccaagttacattcagtatataagacatgaacttggcaagtacaaaagaaaactaaaattgtgacagctacgaccgcgtaataaaacaaccttttttttgtgttttgagtttataactatctatacgaaagaacagtacaataaactgccataattatttacattcccagaaaacaaaaaatcagtttaca

SEQ ID NO: 862 - DNA, 200 bp, Conyza canadensis
ctgaatgtaacttggccaaactcatgtctgcaggtaccttctaaccccattgcactgatccaaagcagtttgctttccactcaatcaaaggttcgttagtagctcttggatgtttaagtctgaagtatttaaaccgtatccaatcctttcattctcatattatctacccaatgattctcaatgtcaaggctcacaaaaac

SEQ ID NO: 863 - DNA, 200 bp, Conyza canadensis
gtttttgtgagccttgacattgagaatcattgggtagataatatgagaatgaaaggattggatacggtttaaatacttcagacttaaacatccaagagctactaacgaacctttgattgagtggaaagcaaactgctttggatcagtgcaatggggttagaaggtacctgcagacatgagtttggccaagttacattcag

SEQ ID NO: 864 - DNA, 200 bp, Conyza canadensis
tctcaatgtcaaggctcacaaaaactctttatcctactatgctttaaatttttaataaaaatgatgcatgcccttttcggttgtatttaaaaaattatccaaaattgcaatggtaatatattagcacacgagttacacaaattctttctcattttgatatcagatgatctcaaaattataatttgtacttcattacattg

SEQ ID NO: 865 - DNA, 200 bp, Conyza canadensis
caatgtaatgaagtacaaattataattttgagatcatctgatatcaaaatgagaaagaatttgtgtaactcgtgtgctaatatattaccattgcaattttggataattttttaaatacaaccgaaaagggcatgcatcatttttattaaaaatttaaagcatagtaggataaagagtttttgtgagccttgacattgaga

SEQ ID NO: 866 - DNA, 200 bp, Conyza canadensis
ttataatttgtacttcattacattgtgtatgtgattatggggtttgttgcaaaaattacagcttcaaatacttttggagccattttcatggaagaagaagaactcgtctgatacacaagaaaggtaatatatagccttctttcctatctatctgttaaaccctattagggactaacttttttatttatttactattttgt

SEQ ID NO: 867 - DNA, 200 bp, Conyza canadensis
acaaaatagtaaataaataaaaaagttagtccctaatagggtttaacagatagataggaaagaaggctatatattacctttcttgtgtatcagacgagttcttcttcttccatgaaaatggctccaaaagtatttgaagctgtaatttttgcaacaaaccccataatcacatacacaatgtaatgaagtacaaattataa

SEQ ID NO: 868 - DNA, 200 bp, Conyza canadensis
cttttttatttatttactattttgtagtgttggtgcattctttcaacgtcattttgggaaggaggtatatgtatattgtaacctttatcttcagttcagttattctggtatacgtctttcttttgatattaaggggtccaagttttcatttgtgtggtacttcaaaatttgtccatgctttccgctatcttaattttcta

SEQ ID NO: 869 - DNA, 200 bp, Conyza canadensis
tagaaaattaagatagcggaaagcatggacaaattttgaagtaccacacaaatgaaaacttggaccccttaatatcaaaagaaagacgtataccagaataactgaactgaagataaaggttacaatatacatatacctccttcccaaaatgacgttgaaagaatgcaccaacactacaaaatagtaaataaataaaaaag

SEQ ID NO: 870 - DNA, 200 bp, Conyza canadensis
tgctttccgctatcttaattttctatacttaatgtacatatgtaaggttgttgagtatctcattaatcctgttgttgctggaacaagcggtggagatccggagtcactttctgtgagtaactcttccatgtccatgctgcttcatattagtgtggggatatacataactgatttcaattaacaaacaaaaacactttaaa

SEQ ID NO: 871 - DNA, 200 bp, Conyza canadensis
tttaaagtgtttttgtttgttaattgaaatcagttatgtatatccccacactaatatgaagcagcatggacatggaagagttactcacagaaagtgactccggatctccaccgcttgttccagcaacaacaggattaatgagatactcaacaaccttacatatgtacattaagtatagaaaattaagatagcggaaagca

SEQ ID NO: 872 - DNA, 200 bp, Conyza canadensis
aattaacaaacaaaaacactttaaagcatgtggaggtgcaaatgcattctttgacacccctgctaagtgctacctctcatcattaaccttctaggttaatctatcaacctcatattttccatacagatgcgctattcattccctgaattatgggatttagagagaaggtatgtaagctacaaaataatatgtaattcatt

SEQ ID NO: 873 - DNA, 200 bp, Conyza canadensis
aatgaattacatattattttgtagcttacataccttctctctaaatcccataattcagggaatgaatagcgcatctgtatggaaaatatgaggttgatagattaacctagaaggttaatgatgagaggtagcacttagcaggggtgtcaaagaatgcatttgcacctccacatgctttaaagtgtttttgtttgttaatt

SEQ ID NO: 874 - DNA, 200 bp, Conyza canadensis
gctacaaaataatatgtaattcattctttaagtgagcttgattatttgttcccatgcaatctactatgattttttattataatatttataaagcttggattcttaaattcaatgtgatgacggtcaaatcaacatgcaggtttggttcactcatttctggggcatttcagtctatgatctcttctcgaggcagaaaaaag

SEQ ID NO: 875 - DNA, 200 bp, Conyza canadensis
cttttttctgcctcgagaagagatcatagactgaaatgccccagaaatgagtgaaccaaacctgcatgttgatttgaccgtcatcacattgaatttaagaatccaagctttataaatattataataaaaaatcatagtagattgcatgggaacaaataatcaagctcacttaaagaatgaattacatattattttgtagc

SEQ ID NO: 876 - DNA, 200 bp, Conyza canadensis
gatctcttctcgaggcagaaaaaagagtccttcaggaagcagcaagcgcaggcgtggctccttttcatttttaggtggaatgcaggtaagattggtgattttgtctgtcaagattcatttattggaatctaatatattctttaaagtagaaacaggccatcaatatattgcttactttgttcttttaaatctttattctc

SEQ ID NO: 877 - DNA, 200 bp, Conyza canadensis
gagaataaagatttaaaagaacaaagtaagcaatatattgatggcctgtttctactttaaagaatatattagattccaataaatgaatcttgacagacaaaatcaccaatcttacctgcattccacctaaaaatgaaaaggagccacgcctgcgcttgctgcttcctgaaggactcttttttctgcctcgagaagagatc

SEQ ID NO: 878 - DNA, 200 bp, Conyza canadensis
tttgttcttttaaatctttattctcatgcagacacttacaaatgcactgagcaaagaagttggacaacatgaacttaatcttcaatccaaggtgcttgaaatgtcctatagctgtgatgataacactactgggagttggtcgatctattgtgctccagatcagaacaaacaattaaatcagcaaccttttgatgctgtga

SEQ ID NO: 879 - DNA, 200 bp, Conyza canadensis
tcacagcatcaaaaggttgctgatttaattgtttgttctgatctggagcacaatagatcgaccaactcccagtagtgttatcatcacagctataggacatttcaagcaccttggattgaagattaagttcatgttgtccaacttctttgctcagtgcatttgtaagtgtctgcatgagaataaagatttaaaagaacaaa

SEQ ID NO: 880 - DNA, 200 bp, Conyza canadensis
aatcagcaaccttttgatgctgtgatcatgactgtgagtatagttgtgttatcttacggtgacattgacataaatttggttaatgttttgcattttgacaagactagtttgtctcagcaacttttttttgtgctatcttggtggatctggattcatcaaatattcaaatctgtggacaaaatatggaaattcttattctc

SEQ ID NO: 881 - DNA, 200 bp, Conyza canadensis
gagaataagaatttccatattttgtccacagatttgaatatttgatgaatccagatccaccaagatagcacaaaaaaaagttgctgagacaaactagtcttgtcaaaatgcaaaacattaaccaaatttatgtcaatgtcaccgtaagataacacaactatactcacagtcatgatcacagcatcaaaaggttgctgatt

SEQ ID NO: 882 - DNA, 200 bp, Conyza canadensis
acaaaatatggaaattcttattctctatttcagaaataggagaattattgtttatacacccatttgttttaatgcttattagtttgtaagtgcaattagaacgtaattaacacagtacatgctcccgaattaggccccacttggcaatgtgaaagaaatgaagattacaaagacaggaagtccgttcctgctcaatttta

SEQ ID NO: 883 - DNA, 200 bp, Conyza canadensis
taaaattgagcaggaacggacttcctgtctttgtaatcttcatttctttcacattgccaagtggggcctaattcgggagcatgtactgtgttaattacgttctaattgcacttacaaactaataagcattaaaacaaatgggtgtataaacaataattctcctatttctgaaatagagaataagaatttccatattttgt

SEQ ID NO: 884 - DNA, 200 bp, Conyza canadensis
ggaagtccgttcctgctcaattttatacctgaggtatgttattgtaccgtgtgagttctatcatatggaattcgtgcagaaccccttagttttagctcttttgaaatttaaacaataatctttaccatggggagatatcctttaaaggaatattttctggtttttataatgcagcttagttatatgccagtttcagtcat

SEQ ID NO: 885 - DNA, 200 bp, Conyza canadensis
atgactgaaactggcatataactaagctgcattataaaaaccagaaaatattcctttaaaggatatctccccatggtaaagattattgtttaaatttcaaaagagctaaaactaaggggttctgcacgaattccatatgatagaactcacacggtacaataacatacctcaggtataaaattgagcaggaacggacttcc

SEQ ID NO: 886 - DNA, 200 bp, Conyza canadensis
ttagttatatgccagtttcagtcataatctctacattcaagaaagagaatgtgaagcggccccttgagggatttggaatgcttgttcctgccaaggagcaggaaaatggtttgaagacgttaggtaaagcttgcctgtgtattatcttttttttttttttccttttcatttttttttcttttttttttctttattgtcta

SEQ ID NO: 887 - DNA, 200 bp, Conyza canadensis
tagacaataaagaaaaaaaaaagaaaaaaaaatgaaaaggaaaaaaaaaaaaaagataatacacaggcaagctttacctaacgtcttcaaaccattttcctgctccttggcaggaacaagcattccaaatccctcaaggggccgcttcacattctctttcttgaatgtagagattatgactgaaactggcatataactaa

SEQ ID NO: 888 - DNA, 200 bp, Conyza canadensis
ttcttttttttttctttattgtctataattattattgaaaattctgttatgcaggcactctcttttcttccatgatgtttccagatcgtgcccctgaagacttgtatctttataccacctttgttgggggaagtcgaaacaaagaactggccaatgcttcgaggtaggcttgatcattgcaataatttctgctcaatatt

SEQ ID NO: 889 - DNA, 200 bp, Conyza canadensis
aatattgagcagaaattattgcaatgatcaagcctacctcgaagcattggccagttctttgtttcgacttcccccaacaaaggtggtataaagatacaagtcttcaggggcacgatctggaaacatcatggaagaaaagagagtgcctgcataacagaattttcaataataattatagacaataaagaaaaaaaaaagaa

SEQ ID NO: 890 - DNA, 200 bp, Conyza canadensis
attgcaataatttctgctcaatattttagcttcaaatttactcaagtattgaggaagtagttgtataatggctgtctctaaaaacttcataagagaatcttcttgaccattccctataggaatatcaatctattatttatgatgattatgatgagtaagtaataatttagtttggaaacttttttggaggaaaggagaaa

SEQ ID NO: 891 - DNA, 200 bp, Conyza canadensis
tttctcctttcctccaaaaaagtttccaaactaaattattacttactcatcataatcatcataaataatagattgatattcctatagggaatggtcaagaagattctcttatgaagtttttagagacagccattatacaactacttcctcaatacttgagtaaatttgaagctaaaatattgagcagaaattattgcaat

SEQ ID NO: 892 - DNA, 200 bp, Conyza canadensis
aaacttttttggaggaaaggagaaatgttggagctttcttgttgctgtttaaggggagaggacataactcaagtataattcttgcaataatatatattttctgtaaatacagggatgagttgaagcagatagtaacttctgacctcagacagttgcttggagcagagggagagccacaatttttgacgtaaggacacatt

SEQ ID NO: 893 - DNA, 200 bp, Conyza canadensis
aatgtgtccttacgtcaaaaattgtggctctccctctgctccaagcaactgtctgaggtcagaagttactatctgcttcaactcatccctgtatttacagaaaatatatattattgcaagaattatacttgagttatgtcctctccccttaaacagcaacaagaaagctccaacatttctcctttcctccaaaaaagttt

SEQ ID NO: 894 - DNA, 200 bp, Conyza canadensis
acaatttttgacgtaaggacacattctagctctgctgcttttattaaacgttagtttatctagatcaaaggattgcaagaattgcattcctgagcactatacaaacaattacacaacttaattttcagcttagactttttcattggcgcatgttcaccaattgaaattgtttcttgaaatttaacttttttttaaaagcc

SEQ ID NO: 895 - DNA, 200 bp, Conyza canadensis
ggcttttaaaaaaaagttaaatttcaagaaacaatttcaattggtgaacatgcgccaatgaaaaagtctaagctgaaaattaagttgtgtaattgtttgtatagtgctcaggaatgcaattcttgcaatcctttgatctagataaactaacgtttaataaaagcagcagagctagaatgtgtccttacgtcaaaaattgt

SEQ ID NO: 896 - DNA, 200 bp, Conyza canadensis
gaaatttaacttttttttaaaagcccgaggttcacagatacttttacaatgtacaagtagcttatgcttaatttgtcttgtgtttttttgttcatgtcatacatgataatgatgtagtttaattgcagtcactattactggagcaaagcatatccattgtacgggcgtgactatggcttagttatggaagcaattgagaa

SEQ ID NO: 897 - DNA, 200 bp, Conyza canadensis
ttctcaattgcttccataactaagccatagtcacgcccgtacaatggatatgctttgctccagtaatagtgactgcaattaaactacatcattatcatgtatgacatgaacaaaaaaacacaagacaaattaagcataagctacttgtacattgtaaaagtatctgtgaacctcgggcttttaaaaaaaagttaaatttc

SEQ ID NO: 898 - DNA, 200 bp, Conyza canadensis
gcttagttatggaagcaattgagaagatggaaagagagctacctggttacttttatgcgggtaaacctttttgtgtttgaaataaagtagatatatacatatctatactcccttataaagagtattagatttcttaaaattaagcattttttttcttcctaaaatacccctacttatacataaaacctttatatatcatc

SEQ ID NO: 899 - DNA, 200 bp, Conyza canadensis
gatgatatataaaggttttatgtataagtaggggtattttaggaagaaaaaaaatgcttaattttaagaaatctaatactctttataagggagtatagatatgtatatatctactttatttcaaacacaaaaaggtttacccgcataaaagtaaccaggtagctctctttccatcttctcaattgcttccataactaagc

SEQ ID NO: 900 - DNA, 200 bp, Conyza canadensis
atacataaaacctttatatatcatcctttcccacattgtctctaatcattacacgctctcatcgaccttttatcacccttcgccaccgccctcctccaccgcctctctcgatctccaccaccgtcttccatcaccttttagccgctacaacgcgcgggcattatgctcgttttaaaaaagcaagttaaaaaggatagtag

SEQ ID NO: 901 - DNA, 200 bp, Conyza canadensis
ctactatcctttttaacttgcttttttaaaacgagcataatgcccgcgcgttgtagcggctaaaaggtgatggaagacggtggtggagatcgagagaggcggtggaggagggcggtggcgaagggtgataaaaggtcgatgagagcgtgtaatgattagagacaatgtgggaaaggatgatatataaaggttttatgtat

SEQ ID NO: 902 - DNA, 200 bp, Conyza canadensis
aaaagcaagttaaaaaggatagtaggttgataagaatgactaaatgaggacaaatctattaggtaaccacaaaggaggacttgcagttggaaaagcaatatcctctggatgcgaagcagccgaatctgtgatttcatatttggattcatattccgatgagaagcgttgctagatgttgtggtaatactatttatgataca

SEQ ID NO: 903 - DNA, 200 bp, Conyza canadensis
tgtatcataaatagtattaccacaacatctagcaacgcttctcatcggaatatgaatccaaatatgaaatcacagattcggctgcttcgcatccagaggatattgcttttccaactgcaagtcctcctttgtggttacctaatagatttgtcctcatttagtcattcttatcaacctactatcctttttaacttgctttt

SEQ ID NO: 904 - DNA, 200 bp, Conyza canadensis
ttgtggtaatactatttatgatacaaaaatgaatgaaattctgagcctgaaccatataatcctgcattttcttaattattattcaaagtgcaagacttttcaggtacgtgtacatctcaagaagttttctttccatcgggattggataaatatggcgaaaaaatagtgtggctttttccggtgtctttgaatgtagtcga

SEQ ID NO: 905 - DNA, 200 bp, Conyza canadensis
tcgactacattcaaagacaccggaaaaagccacactattttttcgccatatttatccaatcccgatggaaagaaaacttcttgagatgtacacgtacctgaaaagtcttgcactttgaataataattaagaaaatgcaggattatatggttcaggctcagaatttcattcatttttgtatcataaatagtattaccacaa

SEQ ID NO: 906 - DNA, 200 bp, Conyza canadensis
ttccggtgtctttgaatgtagtcgaaggactaagctttagttacttttataatgcaataataatggatcaaagtgttgtagaaattgatcgttccggatgatgttaaacattgcaaaatgttgtaacaaaacatggggctcgggttttgcttaatttgcatctgtaacaaaggctcgccatttttgggtatacttttaac

SEQ ID NO: 907 - DNA, 200 bp, Conyza canadensis
gttaaaagtatacccaaaaatggcgagcctttgttacagatgcaaattaagcaaaacccgagccccatgttttgttacaacattttgcaatgtttaacatcatccggaacgatcaatttctacaacactttgatccattattattgcattataaaagtaactaaagcttagtccttcgactacattcaaagacaccggaa

SEQ ID NO: 908 - DNA, 200 bp, Conyza canadensis
cgccatttttgggtatacttttaactatctgtctcaaccaaatagtttaaataaacgtgcttgaattagttgtacttttattataaatagttaggggatgaacttttgatatagaatatacaaattttctattcaagttaattatagccgttagaaaaatccctaaataaaagccaatcaggttttaggttttttttttt

SEQ ID NO: 909 - DNA, 200 bp, Conyza canadensis
aaaaaaaaaaacctaaaacctgattggcttttatttagggatttttctaacggctataattaacttgaatagaaaatttgtatattctatatcaaaagttcatcccctaactatttataataaaagtacaactaattcaagcacgtttatttaaactatttggttgagacagatagttaaaagtatacccaaaaatggcg

SEQ ID NO: 910 - DNA, 200 bp, Conyza canadensis
aatcaggttttaggttttttttttttcttgaaaagttttccattattttaagggttattccttgatggtgagccatttttgctcgttatagcggtctaaatagattttacctgtgaccggtgttatccattcacatggtcacctccaaaatatgcttaaggacatattcgaacttgaaatcttttgtgaggaaacatata

SEQ ID NO: 911 - DNA, 200 bp, Conyza canadensis
tatatgtttcctcacaaaagatttcaagttcgaatatgtccttaagcatattttggaggtgaccatgtgaatggataacaccggtcacaggtaaaatctatttagaccgctataacgagcaaaaatggctcaccatcaaggaataacccttaaaataatggaaaacttttcaagaaaaaaaaaaaacctaaaacctgatt

SEQ ID NO: 912 - DNA, 200 bp, Conyza canadensis
gaaatcttttgtgaggaaacatataattctttcgggttttgctaaacaaagctcaatgggtgtgcattaaatagttgtacacttaccataaaaatcaggggtgagcttttgatatgaaaaagtacaacttttttatgtactataagtgaaaccctaagggctttatttaacattttccaattctttatcactagataaac

SEQ ID NO: 913 - DNA, 200 bp, Conyza canadensis
gtttatctagtgataaagaattggaaaatgttaaataaagcccttagggtttcacttatagtacataaaaaagttgtactttttcatatcaaaagctcacccctgatttttatggtaagtgtacaactatttaatgcacacccattgagctttgtttagcaaaacccgaaagaattatatgtttcctcacaaaagatttc

SEQ ID NO: 914 - DNA, 200 bp, Conyza canadensis
tccaattctttatcactagataaacttgatgatggttagcttctttttttttcctaaacataggtgtcttactcacttagactagacccaaaagttgactcgctttgcgagcccaagtcagagtaggtaagtctctctttgggtcactagagtatttttcttaaggagtttcatccttttagagacatccccaatcaatg

SEQ ID NO: 915 - DNA, 200 bp, Conyza canadensis
cattgattggggatgtctctaaaaggatgaaactccttaagaaaaatactctagtgacccaaagagagacttacctactctgacttgggctcgcaaagcgagtcaacttttgggtctagtctaagtgagtaagacacctatgtttaggaaaaaaaaagaagctaaccatcatcaagtttatctagtgataaagaattgga

SEQ ID NO: 916 - DNA, 200 bp, Conyza canadensis
cttttagagacatccccaatcaatggacctccaccctagtgttttggttggttaataatttagtattattatccctgttatatattcttacaagaggttttagattaaaacattttaggtaatattttaggagtggttagaaaagggttgatcggagaggatgtaaaatattgttacgcaaggggtcagagtggaaagat

SEQ ID NO: 917 - DNA, 200 bp, Conyza canadensis
atctttccactctgaccccttgcgtaacaatattttacatcctctccgatcaacccttttctaaccactcctaaaatattacctaaaatgttttaatctaaaacctcttgtaagaatatataacagggataataatactaaattattaaccaaccaaaacactagggtggaggtccattgattggggatgtctctaaaag

SEQ ID NO: 918 - DNA, 200 bp, Conyza canadensis
acgcaaggggtcagagtggaaagataaaggccggtatagtctttcataggagtttgtgtcctcgaaattcacccaagaactttgtctttgtgctgtcgtacctttttctttttctttcccttttgtctgttactactccgtattaactgacgttttaatattgtttagcttaactaaatagattattggaggattagtat

SEQ ID NO: 919 - DNA, 200 bp, Conyza canadensis
atactaatcctccaataatctatttagttaagctaaacaatattaaaacgtcagttaatacggagtagtaacagacaaaagggaaagaaaaagaaaaaggtacgacagcacaaagacaaagttcttgggtgaatttcgaggacacaaactcctatgaaagactataccggcctttatctttccactctgaccccttgcgt

SEQ ID NO: 920 - DNA, 200 bp, Conyza canadensis
aaatagattattggaggattagtatttgttgtttagtcattaattgaaggtgaatcaagatccgaataaatgaatctaaaacctatttgcttagtcataaatcttcaagaaaagatgaattgttttgcttaattttaatccttaaagcaaacatgaattgaactcttaataaaaaagagctaggtatttatgacggttat

SEQ ID NO: 921 - DNA, 200 bp, Conyza canadensis
ataaccgtcataaatacctagctcttttttattaagagttcaattcatgtttgctttaaggattaaaattaagcaaaacaattcatcttttcttgaagatttatgactaagcaaataggttttagattcatttattcggatcttgattcaccttcaattaatgactaaacaacaaatactaatcctccaataatctattt

SEQ ID NO: 922 - DNA, 200 bp, Conyza canadensis
agagctaggtatttatgacggttattggctgctttaattaagctctttgtctgcatatcccgagtctatccaaatcatcaccccattatgctgtcggtgcttttaggacaaaatcattagtgttaagttcagtcttttaaaaccgttataaagctacaaatattagattcatcttctctacagagaggtgtatcttacat

SEQ ID NO: 923 - DNA, 200 bp, Conyza canadensis
atgtaagatacacctctctgtagagaagatgaatctaatatttgtagctttataacggttttaaaagactgaacttaacactaatgattttgtcctaaaagcaccgacagcataatggggtgatgatttggatagactcgggatatgcagacaaagagcttaattaaagcagccaataaccgtcataaatacctagctct

SEQ ID NO: 924 - DNA, 200 bp, Conyza canadensis
ctctacagagaggtgtatcttacattcttacacttaaaacggataaacagatgaattttttcttattttggtaattttttcgaactttttcactagtcgcttctaagattgtatataatgagattcgaacttgagacacccaattaaggatttgtgcctcgtaaatacatgagctgaagttaaagccaaatcactctttt

SEQ ID NO: 925 - DNA, 200 bp, Conyza canadensis
aaaagagtgatttggctttaacttcagctcatgtatttacgaggcacaaatccttaattgggtgtctcaagttcgaatctcattatatacaatcttagaagcgactagtgaaaaagttcgaaaaaattaccaaaataagaaaaaattcatctgtttatccgttttaagtgtaagaatgtaagatacacctctctgtagag

SEQ ID NO: 926 - DNA, 200 bp, Conyza canadensis
gaagttaaagccaaatcactcttttcacttctaatacctagtagcatattcatcattcattataaaattttacacgttatagttgttcaattatttatagtcgtcattaacatctgtttgagaagttcatcaatttccagtacactggtaatcacttaaaaataattggagtcgtctgtagtcccccctcatatgtgagt

SEQ ID NO: 927 - DNA, 200 bp, Conyza canadensis
actcacatatgaggggggactacagacgactccaattatttttaagtgattaccagtgtactggaaattgatgaacttctcaaacagatgttaatgacgactataaataattgaacaactataacgtgtaaaattttataatgaatgatgaatatgctactaggtattagaagtgaaaagagtgatttggctttaacttc

SEQ ID NO: 928 - DNA, 200 bp, Conyza canadensis
ctgtagtcccccctcatatgtgagtactttttaaattcaagaggacccatagatctttaactacatttattgatttatacattatttcatatagcattttctgcagatacgatttgttatgtagcaacatagacccatgttcagtccaaacatactagtacaattttggagcaatgcaataatgagtatctaaagtttca

SEQ ID NO: 929 - DNA, 200 bp, Conyza canadensis
tgaaactttagatactcattattgcattgctccaaaattgtactagtatgtttggactgaacatgggtctatgttgctacataacaaatcgtatctgcagaaaatgctatatgaaataatgtataaatcaataaatgtagttaaagatctatgggtcctcttgaatttaaaaagtactcacatatgaggggggactacag

SEQ ID NO: 930 - DNA, 200 bp, Conyza canadensis
gcaataatgagtatctaaagtttcatgtgagaataatcaattacttagacactagacgttttttaacaatcagtttgttcctggtacattggcaccaactcgtctgagccttcagcgcgttggccagcaagtagtttcggtttggtggtcactgtcgagcaattgggcacgttaagtattttttttacattttttatttc

SEQ ID NO: 931 - DNA, 200 bp, Conyza canadensis
gaaataaaaaatgtaaaaaaaatacttaacgtgcccaattgctcgacagtgaccaccaaaccgaaactacttgctggccaacgcgctgaaggctcagacgagttggtgccaatgtaccaggaacaaactgattgttaaaaaacgtctagtgtctaagtaattgattattctcacatgaaactttagatactcattattgc

SEQ ID NO: 932 - DNA, 200 bp, Conyza canadensis
atttttttatttaaaagtatatttaaaattttttgcccacaccaaaaaaaaatttaaaaaaaaagaagtacatatgcaatcaatgacatgcgatttcaatcccaactttcaaatctcaatttttaaatgctagtagctataagtaaataatctccattctccttctctatacatcttttcttattcaacaggtaatactt

SEQ ID NO: 933 - DNA, 200 bp, Conyza canadensis
aagtattacctgttgaataagaaaagatgtatagagaaggagaatggagattatttacttatagctactagcatttaaaaattgagatttgaaagttgggattgaaatcgcatgtcattgattgcatatgtacttctttttttttaaatttttttttggtgtgggcaaaaaattttaaatatacttttaaataaaaaaat

SEQ ID NO: 934 - DNA, 200 bp, Conyza canadensis
ttttcttattcaacaggtaatactttcatttattaatcataaaattatacatatatattttccctaatttttaggtttcttaatttcttttgacgtgaattgaaagatgaaaacgtgatgatagattggaagagccgaagaggggttttgttttggggaatctcacacataacacactaaacaacatattatcagttatc

SEQ ID NO: 935 - DNA, 200 bp, Conyza canadensis
gataactgataatatgttgtttagtgtgttatgtgtgagattccccaaaacaaaacccctcttcggctcttccaatctatcatcacgttttcatctttcaattcacgtcaaaagaaattaagaaacctaaaaattagggaaaatatatatgtataattttatgattaataaatgaaagtattacctgttgaataagaaaa

SEQ ID NO: 936 - DNA, 200 bp, Conyza canadensis
actaaacaacatattatcagttatcttgtattgatttaatataaaatatgagtactaaaataccattatatggatcgtataagtttagtgaatagttcgtgcttttggttatacgacgaaattgtagttgatttattatatcgtcttttgagtttgcattttggttgtaattggatggttattattttgtgggtatatga

SEQ ID NO: 937 - DNA, 200 bp, Conyza canadensis
tcatatacccacaaaataataaccatccaattacaaccaaaatgcaaactcaaaagacgatataataaatcaactacaatttcgtcgtataaccaaaagcacgaactattcactaaacttatacgatccatataatggtattttagtactcatattttatattaaatcaatacaagataactgataatatgttgtttagt

SEQ ID NO: 938 - DNA, 200 bp, Conyza canadensis
tggttattattttgtgggtatatgaatttattggaatttgatcgatatattaaaatttttgtacctatataatgttttaaatttgtcaccttacgataaagttcctggctctgccttgatagcagccttcatgtaaaattggttttcataaacgttctgagtttttataaattttgtaacatgtcattcttctggaaata

SEQ ID NO: 939 - DNA, 200 bp, Conyza canadensis
tatttccagaagaatgacatgttacaaaatttataaaaactcagaacgtttatgaaaaccaattttacatgaaggctgctatcaaggcagagccaggaactttatcgtaaggtgacaaatttaaaacattatataggtacaaaaattttaatatatcgatcaaattccaataaattcatatacccacaaaataataacca

SEQ ID NO: 940 - DNA, 200 bp, Conyza canadensis
gtaacatgtcattcttctggaaatatgcttctcttcaatttaacgcgtatatgagcgttgcattcgcatataatcgaatgtctcgtggaaagtactaaagacttggccaacgttaggtttcattatcatcttctgggggattgtttaagtccaacataattaagaattttcaaacagaaggaacaacataggaaaagtca

SEQ ID NO: 941 - DNA, 200 bp, Conyza canadensis
tgacttttcctatgttgttccttctgtttgaaaattcttaattatgttggacttaaacaatcccccagaagatgataatgaaacctaacgttggccaagtctttagtactttccacgagacattcgattatatgcgaatgcaacgctcatatacgcgttaaattgaagagaagcatatttccagaagaatgacatgttac

SEQ ID NO: 942 - DNA, 200 bp, Conyza canadensis
agaaggaacaacataggaaaagtcataatcaactgaatagtttgattagtcaatttatcagtacttaaactaagatatagtaagatgaggttgaaaaacaactactataacatacaaacatatatggatcttccttaaataataacaatgttaaagattactgcaaaaattacagaccttcattttcagcaatgatggta

SEQ ID NO: 943 - DNA, 200 bp, Conyza canadensis
taccatcattgctgaaaatgaaggtctgtaatttttgcagtaatctttaacattgttattatttaaggaagatccatatatgtttgtatgttatagtagttgtttttcaacctcatcttactatatcttagtttaagtactgataaattgactaatcaaactattcagttgattatgacttttcctatgttgttccttct

SEQ ID NO: 944 - DNA, 200 bp, Conyza canadensis
accttcattttcagcaatgatggtatgaagttgaaataatcgtttgttgttttcaattaacattttttcacaaagggagagagataactatggtgatcagctttatatttcaatataatgtgaaaggtctgagaaaaaaatttgaccaagtgtaaaaaatgtgttttggataaataaaagttaatttaaataatctacta

SEQ ID NO: 945 - DNA, 200 bp, Conyza canadensis
tagtagattatttaaattaacttttatttatccaaaacacattttttacacttggtcaaatttttttctcagacctttcacattatattgaaatataaagctgatcaccatagttatctctctccctttgtgaaaaaatgttaattgaaaacaacaaacgattatttcaacttcataccatcattgctgaaaatgaaggt

SEQ ID NO: 946 - DNA, 200 bp, Conyza canadensis
aaaagttaatttaaataatctactaaaattagcccctggtttacaaatatcatttcacttataatttattaaccataatttactaatttgttcagtcaaactttttttttttatatagtttctttatttaacgtactcacaacacattacaatctctcatgttgggtatttttactgctgcattacgtgagttttttttt

SEQ ID NO: 947 - DNA, 200 bp, Conyza canadensis
aaaaaaaaactcacgtaatgcagcagtaaaaatacccaacatgagagattgtaatgtgttgtgagtacgttaaataaagaaactatataaaaaaaaaaagtttgactgaacaaattagtaaattatggttaataaattataagtgaaatgatatttgtaaaccaggggctaattttagtagattatttaaattaactttt

SEQ ID NO: 948 - DNA, 200 bp, Conyza canadensis
tgctgcattacgtgagtttttttttattgtatcatataatttttgacagatgatttttaataaaacaaaccttttcactctttaatggtgaggtttcaactccacagtttaatcaattgccgatcgatgtatatatgtaatttttagttttgatttagtaaatacagaattatttaactagggtataggaagagtagaag

SEQ ID NO: 949 - DNA, 200 bp, Conyza canadensis
cttctactcttcctataccctagttaaataattctgtatttactaaatcaaaactaaaaattacatatatacatcgatcggcaattgattaaactgtggagttgaaacctcaccattaaagagtgaaaaggtttgttttattaaaaatcatctgtcaaaaattatatgatacaataaaaaaaaactcacgtaatgcagca

SEQ ID NO: 950 - DNA, 200 bp, Conyza canadensis
aactagggtataggaagagtagaagacttgaaaatatgggtgataatttcttgattctttcaatttgagtaagttaaaagaaatcttaactcttcaaattttagcatttaatttttatctaaaggttaagattaccataatttggactaatcccctccctaaaaatatatacccattttccttatttgacttggaaaata

SEQ ID NO: 951 - DNA, 200 bp, Conyza canadensis
tattttccaagtcaaataaggaaaatgggtatatatttttagggaggggattagtccaaattatggtaatcttaacctttagataaaaattaaatgctaaaatttgaagagttaagatttcttttaacttactcaaattgaaagaatcaagaaattatcacccatattttcaagtcttctactcttcctataccctagtt

SEQ ID NO: 952 - DNA, 200 bp, Conyza canadensis
ttttccttatttgacttggaaaatagtggggtagatcggatctgacctaacctgatttgacccgatccgacccgaacgttgaaaatgaaaattagtttactagaggtggttcacccacagagaagttataccaaaccgaaacaacccaacaatggcttctccaacaacaactacagatgataacaaaggtagatactatt

SEQ ID NO: 953 - DNA, 200 bp, Conyza canadensis
aatagtatctacctttgttatcatctgtagttgttgttggagaagccattgttgggttgtttcggtttggtataacttctctgtgggtgaaccacctctagtaaactaattttcattttcaacgttcgggtcggatcgggtcaaatcaggttaggtcagatccgatctaccccactattttccaagtcaaataaggaaaa

SEQ ID NO: 954 - DNA, 200 bp, Conyza canadensis
gatgataacaaaggtagatactatttctttttcttcttaataatcttaatatgttattattttcattgtagataatccagttctgcattttgttgcacagagaaagcacctgctaagagagttgcagttgttggtgccggtgtcaggtcaatgttactactttcatatatataatatatgtatcttgcgttttattttac

SEQ ID NO: 955 - DNA, 200 bp, Conyza canadensis
gtaaaataaaacgcaagatacatatattatatatatgaaagtagtaacattgacctgacaccggcaccaacaactgcaactctcttagcaggtgctttctctgtgcaacaaaatgcagaactggattatctacaatgaaaataataacatattaagattattaagaagaaaaagaaatagtatctacctttgttatcatc

SEQ ID NO: 956 - DNA, 200 bp, Conyza canadensis; identical to SEQ ID NO: 836

SEQ ID NO: 957 - DNA, 200 bp, Conyza canadensis; identical to SEQ ID NO: 837

SEQ ID NO: 958 - DNA, 200 bp, Conyza canadensis
tttgaccccaaaaatgctttgcttgtcggaggacatgaccaatatttggaggactaggattagcttagcggaatatggtagataagtaatccttttaggggtactttatataattgtggattgtcatgcatgatacctttcttatatgctcatatgacttctttgcactgttaggggtagtgttctcgacagctaggtga

SEQ ID NO: 959 - DNA, 200 bp, Conyza canadensis
tcacctagctgtcgagaacactacccctaacagtgcaaagaagtcatatgagcatataagaaaggtatcatgcatgacaatccacaattatataaagtacccctaaaaggattacttatctaccatattccgctaagctaatcctagtcctccaaatattggtcatgtcctccgacaagcaaagcatttttggggtcaaa

SEQ ID NO: 960 - DNA, 200 bp, Conyza canadensis
ggtagtgttctcgacagctaggtgacctatgctactttgtttcataggtcgattagggattagcacccactatttttttattttttggaaggcattaaattatattatattaaagataaaaattgccagtaagaaactagccgatacatagactgtccaatccaaaatagaaaactagcacccacattatatgtgggccc

SEQ ID NO: 961 - DNA, 200 bp, Conyza canadensis
gggcccacatataatgtgggtgctagttttctattttggattggacagtctatgtatcggctagtttcttactggcaatttttatctttaatataatataatttaatgccttccaaaaaataaaaaaatagtgggtgctaatccctaatcgacctatgaaacaaagtagcataggtcacctagctgtcgagaacactacc

SEQ ID NO: 962 - DNA, 200 bp, Conyza canadensis
tagcacccacattatatgtgggcccaccggtccctaggacttcctagtaaatatctacttatatctatgtatgcatggctgataccaaccctatttgcttttgtgacttgctgggaggaggttaaaggggttcttgacttcttgcacatgccactcgtactaccaaacctatttgcttctatgacttgctgggaggagac

SEQ ID NO: 963 - DNA, 200 bp, Conyza canadensis
gtctcctcccagcaagtcatagaagcaaataggtttggtagtacgagtggcatgtgcaagaagtcaagaacccctttaacctcctcccagcaagtcacaaaagcaaatagggttggtatcagccatgcatacatagatataagtagatatttactaggaagtcctagggaccggtgggcccacatataatgtgggtgcta

SEQ ID NO: 964 - DNA, 200 bp, Conyza canadensis
cttctatgacttgctgggaggagacatgcccctattaattgttgctctcatcccacatgtttggttctatgcagacggttatatttattatgtttttatgatgtttaatatgttcaaatgtcttatttactatgtattgtccaatttgggctatgtggtatgtcttctacccttgtctactcttaatgtagtaagagtat

SEQ ID NO: 965 - DNA, 200 bp, Conyza canadensis
atactcttactacattaagagtagacaagggtagaagacataccacatagcccaaattggacaatacatagtaaataagacatttgaacatattaaacatcataaaaacataataaatataaccgtctgcatagaaccaaacatgtgggatgagagcaacaattaataggggcatgtctcctcccagcaagtcatagaag

SEQ ID NO: 966 - DNA, 200 bp, Conyza canadensis
tctactcttaatgtagtaagagtatcatgatactcggtcgacaggtatggttactgaactctttacactctcctacttttgccttttttggatggaggtccttatggaagtagtctttctgcctctgggtagaggcaagactgtctacatctcacatcccccatacccctcgcacaagaattgggtcatgttgtttttgt

SEQ ID NO: 967 - DNA, 200 bp, Conyza canadensis
acaaaaacaacatgacccaattcttgtgcgaggggtatgggggatgtgagatgtagacagtcttgcctctacccagaggcagaaagactacttccataaggacctccatccaaaaaaggcaaaagtaggagagtgtaaagagttcagtaaccatacctgtcgaccgagtatcatgatactcttactacattaagagtaga

SEQ ID NO: 968 - DNA, 200 bp, Conyza canadensis
aagaattgggtcatgttgtttttgtggactcgaacccagatggtaagatgtttccaatggggtttacatattgttgattttttgctgctagtataatatattattttgattattcgttacatgtatgaaatttgtaaataaattggtgagtatagtagtctagtgcaacatggtgattgattgatatctagaggaatggc

SEQ ID NO: 969 - DNA, 200 bp, Conyza canadensis
gccattcctctagatatcaatcaatcaccatgttgcactagactactatactcaccaatttatttacaaatttcatacatgtaacgaataatcaaaataatatattatactagcagcaaaaaatcaacaatatgtaaaccccattggaaacatcttaccatctgggttcgagtccacaaaaacaacatgacccaattctt

SEQ ID NO: 970 - DNA, 200 bp, Conyza canadensis
attgattgatatctagaggaatggccggccatattatgttgaatcatgaatgaatgacttggtttgtttcagtgggcttgcggctgcatataagttaaaactacatggaataaatgtcactgtttttgaagccggtgagatagccggagggaaactaagaagcatttcacaaaacggtttaatatgggacgagggtgcca

SEQ ID NO: 971 - DNA, 200 bp, Conyza canadensis
tggcaccctcgtcccatattaaaccgttttgtgaaatgcttcttagtttccctccggctatctcaccggcttcaaaaacagtgacatttattccatgtagttttaacttatatgcagccgcaagcccactgaaacaaaccaagtcattcattcatgattcaacataatatggccggccattcctctagatatcaatcaat

SEQ ID NO: 972 - DNA, 200 bp, Conyza canadensis
ggtttaatatgggacgagggtgccaatactatggtatgatatcgatgttagtttgcttatagatatagacataacttacttctttttttttattttttttaaaaaaaagttgttttgatgctcttttactccgtatttgtagactgagagtgaaccggatgtcagcaggttgcttgatgatcttggtcttcgagataaac

SEQ ID NO: 973 - DNA, 200 bp, Conyza canadensis
gtttatctcgaagaccaagatcatcaagcaacctgctgacatccggttcactctcagtctacaaatacggagtaaaagagcatcaaaacaacttttttttaaaaaaaataaaaaaaaagaagtaagttatgtctatatctataagcaaactaacatcgatatcataccatagtattggcaccctcgtcccatattaaacc

SEQ ID NO: 974 - DNA, 200 bp, Conyza canadensis
gatgatcttggtcttcgagataaacaacagtctgtaagttatatgctgttggatatggaacatcatgcttcctgtagcgtgcgtttgaaaatttatttttgcaaatttctcccattgtatactaaatgacatagtataaagaagaggaaattgtttatatcacttttattcgtgttcaaatacggaaggctaaatccact

SEQ ID NO: 975 - DNA, 200 bp, Conyza canadensis
agtggatttagccttccgtatttgaacacgaataaaagtgatataaacaatttcctcttctttatactatgtcatttagtatacaatgggagaaatttgcaaaaataaattttcaaacgcacgctacaggaagcatgatgttccatatccaacagcatataacttacagactgttgtttatctcgaagaccaagatcatc

SEQ ID NO: 976 - DNA, 200 bp, Conyza canadensis
tcaaatacggaaggctaaatccactttatgtggctgtggctgtaataatttgtcggctatggttcttgtttcatttatttgttgtggtcatgtgtgtatatgtttaccatggctgaatactacactatatttccttttgcagccactttcccaacataagcgatatattgtaagaaatggaaaaccggtactggtatgat

SEQ ID NO: 977 - DNA, 200 bp, Conyza canadensis
atcataccagtaccggttttccatttcttacaatatatcgcttatgttgggaaagtggctgcaaaaggaaatatagtgtagtattcagccatggtaaacatatacacacatgaccacaacaaataaatgaaacaagaaccatagccgacaaattattacagccacagccacataaagtggatttagccttccgtatttga

SEQ ID NO: 978 - DNA, 200 bp, Conyza canadensis
aatggaaaaccggtactggtatgatatctcaacaccatgctgaaaactaatcctctgttatatatgaacaaaagagtttaaaagtataagatgaaactttacttcaaaatcattagtagaaattgtgttttattggactcaaattctcaacctcataaacacttgtcatttgtttacaaagttttgtaaactgattttgg

SEQ ID NO: 979 - DNA, 200 bp, Conyza canadensis
ccaaaatcagtttacaaaactttgtaaacaaatgacaagtgtttatgaggttgagaatttgagtccaataaaacacaatttctactaatgattttgaagtaaagtttcatcttatacttttaaactcttttgttcatatataacagaggattagttttcagcatggtgttgagatatcataccagtaccggttttccatt

SEQ ID NO: 980 - DNA, 200 bp, Conyza canadensis
acaaagttttgtaaactgattttggttttctgggaatgtaaataattatggcagtttattgtactgttctttcgtatagatagttataaactcaaaacacaaaaaaaaaggttgttttattacgcggtcgtagctgtcacaattttagttttcttttgtacttgccaagttcatgtcttatatactgaatgtaacttggc

SEQ ID NO: 981 - DNA, 200 bp, Conyza canadensis
gccaagttacattcagtatataagacatgaacttggcaagtacaaaagaaaactaaaattgtgacagctacgaccgcgtaataaaacaacctttttttttgtgttttgagtttataactatctatacgaaagaacagtacaataaactgccataattatttacattcccagaaaaccaaaatcagtttacaaaactttgt

SEQ ID NO: 982 - DNA, 200 bp, Conyza canadensis
tcttatatactgaatgtaacttggccaaactcatgtctgcaggtaccttctaaccccattgcactgatccaaagcagtttgctttccactcaatcaaaggttcgttagtagctcttggatgtttaagtctgaagtatttaaaccgtatccaatcctttcattctcatattatctacccaatgattctcaatgtcaaggct

SEQ ID NO: 983 - DNA, 200 bp, Conyza canadensis
agccttgacattgagaatcattgggtagataatatgagaatgaaaggattggatacggtttaaatacttcagacttaaacatccaagagctactaacgaacctttgattgagtggaaagcaaactgctttggatcagtgcaatggggttagaaggtacctgcagacatgagtttggccaagttacattcagtatataaga

SEQ ID NO: 984 - DNA, 200 bp, Conyza canadensis
cccaatgattctcaatgtcaaggctcacaaaaactctttatcctactatgctttaaatttttaataaaaatgatgcatgcccttttcggttgtatttaaaaaattatccaaaattgcaatggtaatatattagcacacgagttacacaaattctttctcattttgatatcagatgatctcaaaattataatttgtacttc

SEQ ID NO: 985 - DNA, 200 bp, Conyza canadensis
gaagtacaaattataattttgagatcatctgatatcaaaatgagaaagaatttgtgtaactcgtgtgctaatatattaccattgcaattttggataattttttaaatacaaccgaaaagggcatgcatcatttttattaaaaatttaaagcatagtaggataaagagtttttgtgagccttgacattgagaatcattggg

SEQ ID NO: 986 - DNA, 200 bp, Conyza canadensis
atctcaaaattataatttgtacttcattacattgtgtatgtgattatggggtttgttgcaaaaattacagcttcaaatacttttggagccattttcatggaagaagaagaactcgtctgatacacaagaaaggtaatatatagccttctttcctatctatctgttaaaccctattagggactaactttttatttatttac

SEQ ID NO: 987 - DNA, 200 bp, Conyza canadensis
gtaaataaataaaaagttagtccctaatagggtttaacagatagataggaaagaaggctatatattacctttcttgtgtatcagacgagttcttcttcttccatgaaaatggctccaaaagtatttgaagctgtaatttttgcaacaaaccccataatcacatacacaatgtaatgaagtacaaattataattttgagat

SEQ ID NO: 988 - DNA, 200 bp, Conyza canadensis
agggactaactttttatttatttactattttgtagtgttggtgcattctttcaacgtcattttgggaaggaggtatatgtatattgtaacctttatcttcagttcagttattctggtatacgtctttcttttgatattaaggggtccaagttttcatttgtgtggtacttcaaaatttgtccatgctttccgctatctta

SEQ ID NO: 989 - DNA, 200 bp, Conyza canadensis
taagatagcggaaagcatggacaaattttgaagtaccacacaaatgaaaacttggaccccttaatatcaaaagaaagacgtataccagaataactgaactgaagataaaggttacaatatacatatacctccttcccaaaatgacgttgaaagaatgcaccaacactacaaaatagtaaataaataaaaagttagtccct

SEQ ID NO: 990 - DNA, 200 bp, Conyza canadensis
tttgtccatgctttccgctatcttaattttctatacttaatgtacatatgtaaggttgttgagtatctcattaatcctgttgttgctggaacaagcggtggagatccggagtcactttctgtgagtaactcttccatgtccatgctgcttcatattagtgtggggatatacataactgatttcaattaacaaacaaaaac

SEQ ID NO: 991 - DNA, 200 bp, Conyza canadensis
gtttttgtttgttaattgaaatcagttatgtatatccccacactaatatgaagcagcatggacatggaagagttactcacagaaagtgactccggatctccaccgcttgttccagcaacaacaggattaatgagatactcaacaaccttacatatgtacattaagtatagaaaattaagatagcggaaagcatggacaaa

SEQ ID NO: 992 - DNA, 200 bp, Conyza canadensis
ctgatttcaattaacaaacaaaaacactttaaagcatgtggaggtgcaaatgcattctttgacacccctgctaagtgctacctctcatcattaaccttctaggttaatctatcaacctcatattttccatacagatgcgctattcattccctgaattatgggatttagagagaaggtatgtaagctacaaaataatatgt

SEQ ID NO: 993 - DNA, 200 bp, Conyza canadensis
acatattattttgtagcttacataccttctctctaaatcccataattcagggaatgaatagcgcatctgtatggaaaatatgaggttgatagattaacctagaaggttaatgatgagaggtagcacttagcaggggtgtcaaagaatgcatttgcacctccacatgctttaaagtgtttttgtttgttaattgaaatcag

SEQ ID NO: 994 - DNA, 200 bp, Conyza canadensis
gtatgtaagctacaaaataatatgtaattcattctttaagtgagcttgattatttgttcccatgcaatctactatgattttttattataatatttataaagcttggattcttaaattcaatgtgatgatggtcaaatcaacatgcaggtttggttcactcatttctggggcatttcagtctatgatctcttctcgaggca

SEQ ID NO: 995 - DNA, 200 bp, Conyza canadensis
tgcctcgagaagagatcatagactgaaatgccccagaaatgagtgaaccaaacctgcatgttgatttgaccatcatcacattgaatttaagaatccaagctttataaatattataataaaaaatcatagtagattgcatgggaacaaataatcaagctcacttaaagaatgaattacatattattttgtagcttacatac

SEQ ID NO: 996 - DNA, 200 bp, Conyza canadensis
cagtctatgatctcttctcgaggcagaaaaaagagtccttcaggaagcagcaagcgcaggcgtggctccttttcatttttaggtggaatgcaggtaagattggtgattttgtctgtcaagattcatttattggaatctaatatattctttaaagtagaaacaggccatcaatatattgcttactttgttcttttaaatct

SEQ ID NO: 997 - DNA, 200 bp, Conyza canadensis
agatttaaaagaacaaagtaagcaatatattgatggcctgtttctactttaaagaatatattagattccaataaatgaatcttgacagacaaaatcaccaatcttacctgcattccacctaaaaatgaaaaggagccacgcctgcgcttgctgcttcctgaaggactcttttttctgcctcgagaagagatcatagactg

SEQ ID NO: 998 - DNA, 200 bp, Conyza canadensis
ttgcttactttgttcttttaaatctttattctcatgcagacacttacaaatgcactgagcaaagaagttggacaacatgaacttaatcttcaatccaaggtgcttgaaatgtcctatagctgtgatgataacactactgggaattggtcgatctattgtgctccagatcagaacaaacaattaaatcagcaaccttttga

SEQ ID NO: 999 - DNA, 200 bp, Conyza canadensis
tcaaaaggttgctgatttaattgtttgttctgatctggagcacaatagatcgaccaattcccagtagtgttatcatcacagctataggacatttcaagcaccttggattgaagattaagttcatgttgtccaacttctttgctcagtgcatttgtaagtgtctgcatgagaataaagatttaaaagaacaaagtaagcaa

SEQ ID NO: 1000 - DNA, 200 bp, Conyza canadensis
aacaattaaatcagcaaccttttgatgctgtgatcatgactgtgagtatagttgtgttatcttacggtgacattgacataaatttggttaatgttttgcattttgacaagactagtttgtctcagcaacttttttttgtgctatcttggtggatctggattcatcaaatattcaaatctgtggacaaaatatggaaattc

SEQ ID NO: 1001 - DNA, 200 bp, Conyza canadensis
gaatttccatattttgtccacagatttgaatatttgatgaatccagatccaccaagatagcacaaaaaaaagttgctgagacaaactagtcttgtcaaaatgcaaaacattaaccaaatttatgtcaatgtcaccgtaagataacacaactatactcacagtcatgatcacagcatcaaaaggttgctgatttaattgtt

SEQ ID NO: 1002 - DNA, 200 bp, Conyza canadensis
atctgtggacaaaatatggaaattcttattctctatttcagaaataggagaattattgtttatacacccatttgttttaatgcttattagtttgtaagtgcaattagaacgtaattaacacagtacatgctcccgaattaggccccacttggcaatgtgaaagaaatgaagattacaaagacaggaagtctgttcctgct

SEQ ID NO: 1003 - DNA, 200 bp, Conyza canadensis
agcaggaacagacttcctgtctttgtaatcttcatttctttcacattgccaagtggggcctaattcgggagcatgtactgtgttaattacgttctaattgcacttacaaactaataagcattaaaacaaatgggtgtataaacaataattctcctatttctgaaatagagaataagaatttccatattttgtccacagat

SEQ ID NO: 1004 - DNA, 200 bp, Conyza canadensis
caaagacaggaagtctgttcctgctcaattttatacctgaggtatgttattgtaccgtgtgagttctatcatatggaattcgtgcagaaccccttagttttagctcttttgaaatttaaacaataatctttaccatggggagatatcctttaaaggaatattttctggtttttataatgcagcttagttatatgccagtt

SEQ ID NO: 1005 - DNA, 200 bp, Conyza canadensis
aactggcatataactaagctgcattataaaaaccagaaaatattcctttaaaggatatctccccatggtaaagattattgtttaaatttcaaaagagctaaaactaaggggttctgcacgaattccatatgatagaactcacacggtacaataacatacctcaggtataaaattgagcaggaacagacttcctgtctttg

SEQ ID NO: 1006 - DNA, 200 bp, Conyza canadensis
aatgcagcttagttatatgccagtttcagtcataatctctacattcaagaaagagaatgtgaagcggccccttgagggatttggaatgcttgttcctgccaaggagcaggaaaatggtttgaagacgttaggtaaagcttgcctgtgtattatcttttttttttttttccttttcatttttttttcatttttttttcttt

SEQ ID NO: 1007 - DNA, 200 bp, Conyza canadensis
aaagaaaaaaaaatgaaaaaaaaatgaaaaggaaaaaaaaaaaaaagataatacacaggcaagctttacctaacgtcttcaaaccattttcctgctccttggcaggaacaagcattccaaatccctcaaggggccgcttcacattctctttcttgaatgtagagattatgactgaaactggcatataactaagctgcatt

SEQ ID NO: 1008 - DNA, 200 bp, Conyza canadensis
atttttttttcatttttttttctttattgtctataattattattgaaaattctgttatgcaggcactctcttttcttccatgatgtttccagatcgtgcccctgaagacttgtatctttataccacctttgttgggggaagtcgaaacaaagaactggccaatgcttcgaggtaggcttgatcattgcaataatttctgc

SEQ ID NO: 1009 - DNA, 200 bp, Conyza canadensis
gcagaaattattgcaatgatcaagcctacctcgaagcattggccagttctttgtttcgacttcccccaacaaaggtggtataaagatacaagtcttcaggggcacgatctggaaacatcatggaagaaaagagagtgcctgcataacagaattttcaataataattatagacaataaagaaaaaaaaatgaaaaaaaaat

SEQ ID NO: 1010 - DNA, 200 bp, Conyza canadensis
gcttgatcattgcaataatttctgctcaatattttagcttcaaatttactcaagtattgaggaagtagttgtataatggctgtctctaaaaacttcataagagaatcttcttgaccattccctataggaatatcaatctattatttatgatgattatgatgagtaagtaataatttagtttggaaacttttttggaggaa

SEQ ID NO: 1011 - DNA, 200 bp, Conyza canadensis
ttcctccaaaaaagtttccaaactaaattattacttactcatcataatcatcataaataatagattgatattcctatagggaatggtcaagaagattctcttatgaagtttttagagacagccattatacaactacttcctcaatacttgagtaaatttgaagctaaaatattgagcagaaattattgcaatgatcaagc

SEQ ID NO: 1012 - DNA, 200 bp, Conyza canadensis
tagtttggaaacttttttggaggaaaggagaaatgttggagctttcttgttgctgtttaaggggagaggacataactcaagtataattcttgcaataatatatattttctgtaaatacagggatgagttgaagcagatagtaacttctgacctcagacagttgcttggagcagagggagagccacaatttttgacgtaag

SEQ ID NO: 1013 - DNA, 200 bp, Conyza canadensis
cttacgtcaaaaattgtggctctccctctgctccaagcaactgtctgaggtcagaagttactatctgcttcaactcatccctgtatttacagaaaatatatattattgcaagaattatacttgagttatgtcctctccccttaaacagcaacaagaaagctccaacatttctcctttcctccaaaaaagtttccaaacta

SEQ ID NO: 1014 - DNA, 200 bp, Conyza canadensis
ggagagccacaatttttgacgtaaggacacattctagctctgctgcttttattaaacgttagtttatctagatcaaaggattgcaagaattgcattcctgagcactatacaaacaattacacaacttaattttcagcttagactttttcattggcgcatgttcaccaattgaaattgtttcttgaaatttaacttttttt

SEQ ID NO: 1015 - DNA, 200 bp, Conyza canadensis
aaaaaaagttaaatttcaagaaacaatttcaattggtgaacatgcgccaatgaaaaagtctaagctgaaaattaagttgtgtaattgtttgtatagtgctcaggaatgcaattcttgcaatcctttgatctagataaactaacgtttaataaaagcagcagagctagaatgtgtccttacgtcaaaaattgtggctctcc

SEQ ID NO: 1016 - DNA, 200 bp, Conyza canadensis
tgtttcttgaaatttaacttttttttaaaagcccgaggttcacagatacttgtacaatgtacaagtagcttatgcttaatttgtcttgtgtttttttgttcatgtcatacatgataatgatgtagtttaattgcagtcactattactggagcaaagcatatccattgtacgggcgtgactatggcttagttatggaagca

SEQ ID NO: 1017 - DNA, 200 bp, Conyza canadensis
tgcttccataactaagccatagtcacgcccgtacaatggatatgctttgctccagtaatagtgactgcaattaaactacatcattatcatgtatgacatgaacaaaaaaacacaagacaaattaagcataagctacttgtacattgtacaagtatctgtgaacctcgggcttttaaaaaaaagttaaatttcaagaaaca

SEQ ID NO: 1018 - DNA, 200 bp, Conyza canadensis
tgactatggcttagttatggaagcaattgagaagatggaaagagagctacctggttacttttatgcgggtaaacctttttgtgtttgaaataaagtagatatatacatatctatactcccttataaagagtattagatttcttaaaattaagcattttttttcttcctaaaatacccctacttatacataaaacctttat

SEQ ID NO: 1019 - DNA, 200 bp, Conyza canadensis
ataaaggttttatgtataagtaggggtattttaggaagaaaaaaaatgcttaattttaagaaatctaatactctttataagggagtatagatatgtatatatctactttatttcaaacacaaaaaggtttacccgcataaaagtaaccaggtagctctctttccatcttctcaattgcttccataactaagccatagtca

SEQ ID NO: 1020 - DNA, 200 bp, Conyza canadensis
ccctacttatacataaaacctttatatatcatcctttcccacattgtctctaatcattacacgctctcctcgaccttctatcaccctccgccgccgccctccttctccaccaccgccctcgatctccaccaccgcctcccttttatattgtcatcgccttttagccgttgcaacgcgcggacactatgctcgtattaaaa

SEQ ID NO: 1021 - DNA, 200 bp, Conyza canadensis
ttttaatacgagcatagtgtccgcgcgttgcaacggctaaaaggcgatgacaatataaaagggaggcggtggtggagatcgagggcggtggtggagaaggagggcggcggcggagggtgatagaaggtcgaggagagcgtgtaatgattagagacaatgtgggaaaggatgatatataaaggttttatgtataagtaggg

SEQ ID NO: 1022 - DNA, 200 bp, Conyza canadensis
cgcggacactatgctcgtattaaaagtagtaacgtaataaacataaagtttacgtaaagtttatatatttcattattttgttatgattttgtactgatgaatatatatttaagctaaaatcattcactctagagtgtaagtcgaacgggtccaaactgaactaaactatttgtctatggtagtcaaattcttaatctttt

SEQ ID NO: 1023 - DNA, 200 bp, Conyza canadensis
aaaagattaagaatttgactaccatagacaaatagtttagttcagtttggacccgttcgacttacactctagagtgaatgattttagcttaaatatatattcatcagtacaaaatcataacaaaataatgaaatatataaactttacgtaaactttatgtttattacgttactacttttaatacgagcatagtgtccgcg

SEQ ID NO: 1024 - DNA, 200 bp, Conyza canadensis
atggtagtcaaattcttaatctttttggtatcgatcgttgtgtagtgttgcacacctcacttgatattagttttatgtgattatatatggttaatttaatttttctttgatttttgatcatggtcttaaatatcattaaaggtgaagaaacatgtgaagagggataaatttggagaaagaatggcatcactaaaacagat

SEQ ID NO: 1025 - DNA, 200 bp, Conyza canadensis
atctgttttagtgatgccattctttctccaaatttatccctcttcacatgtttcttcacctttaatgatatttaagaccatgatcaaaaatcaaagaaaaattaaattaaccatatataatcacataaaactaatatcaagtgaggtgtgcaacactacacaacgatcgataccaaaaagattaagaatttgactaccat

SEQ ID NO: 1026 - DNA, 200 bp, Conyza canadensis
aaagaatggcatcactaaaacagatagtgtcaccctatggcaaggttagtccttctttaagtttattaattatatgtaatttgtttgattaggtatatcatatatgtatactagttgttttgatttccaatctatacaagtaggattttgctaaacatagttgtaagggttatagttacaacacaatagaatggtataca

SEQ ID NO: 1027 - DNA, 200 bp, Conyza canadensis
tgtataccattctattgtgttgtaactataacccttacaactatgtttagcaaaatcctacttgtatagattggaaatcaaaacaactagtatacatatatgatatacctaatcaaacaaattacatataattaataaacttaaagaaggactaaccttgccatagggtgacactatctgttttagtgatgccattcttt

SEQ ID NO: 1028 - DNA, 200 bp, Conyza canadensis
ttacaacacaatagaatggtatacatacattatatatatataaagatatataactgtttattaataataatctttaaccgtcatgtaaaccaatttactttgctttatccatatccttaaaggctatgaatagcatagtcgatgtaagtatatggttgcttagacggtgtgttaatgttgatcgtacaggagtctagact

SEQ ID NO: 1029 - DNA, 200 bp, Conyza canadensis
agtctagactcctgtacgatcaacattaacacaccgtctaagcaaccatatacttacatcgactatgctattcatagcctttaaggatatggataaagcaaagtaaattggtttacatgacggttaaagattattattaataaacagttatatatctttatatatatataatgtatgtataccattctattgtgttgtaa

SEQ ID NO: 1030 - DNA, 200 bp, Conyza canadensis
tgttgatcgtacaggagtctagacttggaccattgtgttttagagaagaagggaatcgaacgcaaaggtaaaacttcctttatttttaagagcatagttataatatcattcaaatttaaccaacaatttctgttacatacatcgaaataggcttgattactcatacctatagagatgagtgacatgtgtgtatgaagatt

SEQ ID NO: 1031 - DNA, 200 bp, Conyza canadensis
aatcttcatacacacatgtcactcatctctataggtatgagtaatcaagcctatttcgatgtatgtaacagaaattgttggttaaatttgaatgatattataactatgctcttaaaaataaaggaagttttacctttgcgttcgattcccttcttctctaaaacacaatggtccaagtctagactcctgtacgatcaaca

SEQ ID NO: 1032 - DNA, 200 bp, Conyza canadensis
tgagtgacatgtgtgtatgaagatttatatattgaattgtaggatatcattttcccatttctaatgtactagttaattatggtttgcggtttttttctttgttgtatgtccattacaaaattacagttggacatcttcttggtggaattcagatgatataaaatagttaattttaccaaacactacatcattggtagaga

SEQ ID NO: 1033 - DNA, 200 bp, Conyza canadensis
tctctaccaatgatgtagtgtttggtaaaattaactattttatatcatctgaattccaccaagaagatgtccaactgtaattttgtaatggacatacaacaaagaaaaaaaccgcaaaccataattaactagtacattagaaatgggaaaatgatatcctacaattcaatatataaatcttcatacacacatgtcactca

SEQ ID NO: 1034 - DNA, 200 bp, Conyza canadensis
ccaaacactacatcattggtagagagaaattagaacgtagataaatggtttgtaagtttcaaaagagatactcgtattacataaaatgttgtcttttgcaattcgcagatttccaattacaacagatttgacacaatgttctattatttgttaatccaaccatgaaccactaataaaacagtacaaacatcttgaataaa

SEQ ID NO: 1035 - DNA, 200 bp, Conyza canadensis
tttattcaagatgtttgtactgttttattagtggttcatggttggattaacaaataatagaacattgtgtcaaatctgttgtaattggaaatctgcgaattgcaaaagacaacattttatgtaatacgagtatctcttttgaaacttacaaaccatttatctacgttctaatttctctctaccaatgatgtagtgtttgg

SEQ ID NO: 1036 - DNA, 200 bp, Conyza canadensis
aaacagtacaaacatcttgaataaaaaaaagccaccaatacattattgattgttgtatgctttttgtctccatataatgaccagtaatatcaaaaaacatgtattttattcttattctagcttaaaaaggttcaaaaatgcacatccaactttctctcttctttccaatcatagcttttcaaattaaaagcatacacgta

SEQ ID NO: 1037 - DNA, 200 bp, Conyza canadensis
tacgtgtatgcttttaatttgaaaagctatgattggaaagaagagagaaagttggatgtgcatttttgaacctttttaagctagaataagaataaaatacatgttttttgatattactggtcattatatggagacaaaaagcatacaacaatcaataatgtattggtggcttttttttattcaagatgtttgtactgttt

SEQ ID NO: 1038 - DNA, 200 bp, Conyza canadensis
ttttcaaattaaaagcatacacgtaaaagaaacatatggatgtagattgatatgtgtgtggggggtagttggttaaccatgtcacgtgctctgcatcacctcccatccttggaccccaatttgttttttgtacctactacatatttaagtaactttatggcacctcaccaaaaaccaaccaaacaaaccaaactcccaac

SEQ ID NO: 1039 - DNA, 200 bp, Conyza canadensis
gttgggagtttggtttgtttggttggtttttggtgaggtgccataaagttacttaaatatgtagtaggtacaaaaaacaaattggggtccaaggatgggaggtgatgcagagcacgtgacatggttaaccaactaccccccacacacatatcaatctacatccatatgtttcttttacgtgtatgcttttaatttgaaaa

SEQ ID NO: 1040 - DNA, 200 bp, Conyza canadensis
caaccaaacaaaccaaactcccaactatacatcacttaattgcacacacacatatacctcaacaagtacttacatctctcccagatttctgtcattccaattttcttgtttttaatcacaattttgttgttgttgtcaatgtctgtctcttttcaaaccagctaaaaaaagaagcaaattcttgatttgattcagctgtt

SEQ ID NO: 1041 - DNA, 200 bp, Conyza canadensis
aacagctgaatcaaatcaagaatttgcttctttttttagctggtttgaaaagagacagacattgacaacaacaacaaaattgtgattaaaaacaagaaaattggaatgacagaaatctgggagagatgtaagtacttgttgaggtatatgtgtgtgtgcaattaagtgatgtatagttgggagtttggtttgtttggttg

SEQ ID NO: 1042 - DNA, 200 bp, Conyza canadensis
aaattcttgatttgattcagctgttgttccacttgtttatggttagtctttctcattctttcaccccccaagtttaaatctttgagttaatttcttcaaattcctgtgttttttgaaccgggtttttatcagttttgttgagtttagcaaaaaagtagagttgggtatgtaaagattgaatctttttactgggtttatgt

SEQ ID NO: 1043 - DNA, 200 bp, Conyza canadensis
acataaacccagtaaaaagattcaatctttacatacccaactctacttttttgctaaactcaacaaaactgataaaaacccggttcaaaaaacacaggaatttgaagaaattaactcaaagatttaaacttggggggtgaaagaatgagaaagactaaccataaacaagtggaacaacagctgaatcaaatcaagaattt

SEQ ID NO: 1044 - DNA, 200 bp, Conyza canadensis
ttgaatctttttactgggtttatgtaatttctttgaaatttataagtttcttgcaatgggtatatgattttctattgattgaagtggttaataacaggatttggtgagtaaagtttgaatctttcgagttatggatttatgtcataccttttcttgcccttcaaaataaagtcaaagctttagttttgtgatttgacttt

SEQ ID NO: 1045 - DNA, 200 bp, Conyza canadensis
aaagtcaaatcacaaaactaaagctttgactttattttgaagggcaagaaaaggtatgacataaatccataactcgaaagattcaaactttactcaccaaatcctgttattaaccacttcaatcaatagaaaatcatatacccattgcaagaaacttataaatttcaaagaaattacataaacccagtaaaaagattcaa

SEQ ID NO: 1046 - DNA, 200 bp, Conyza canadensis
agctttagttttgtgatttgactttggtatcccttcaaaataaagtcaaagctttagttttgtgatttgactttggtatgctgttgctcccatgaatattttcatgctgtttgtaaattgtaatatatattttgataaattcaattttgttatatttgtttcctgataaagttttaatgtgattagtgattacttcaatt

SEQ ID NO: 1047 - DNA, 200 bp, Conyza canadensis
aattgaagtaatcactaatcacattaaaactttatcaggaaacaaatataacaaaattgaatttatcaaaatatatattacaatttacaaacagcatgaaaatattcatgggagcaacagcataccaaagtcaaatcacaaaactaaagctttgactttattttgaagggataccaaagtcaaatcacaaaactaaagct

SEQ ID NO: 1048 - DNA, 200 bp, Conyza canadensis
cgattcgagttcccggccattgctcgattgcgtggtcgtcggcgccggaattagcggactgtgtatagcgcaagcgttgtcaacgaagcacggcggcgacgtggtcgtgacagaggcgcgtgagagagttggaggaaatatatcgacagttgaaagagatggttatttatgggaagaaggtcctaatagctttcaaccct

SEQ ID NO: 1049 - DNA, 200 bp, Conyza canadensis
agggttgaaagctattaggaccttcttcccataaataaccatctctttcaactgtcgatatatttcctccaactctctcacgcgcctctgtcacgaccacgtcgccgccgtgcttcgttgacaacgcttgcgctatacacagtccgctaattccggcgccgacgaccacgcaatcgagcaatggccgggaactcgaatcg

SEQ ID NO: 1050 - DNA, 200 bp, Conyza canadensis
gaaggtcctaatagctttcaaccctccgatcctatgcttactatggtggtggacagtggattgaaggatgatttggtgttgggtgatccaactgcacctcggtttgtgttatgggatggtgatctgaagccggtgccttccagtccatctgatttgcctacctttgatctgatgagccttggtgggaaactccgagccgg

SEQ ID NO: 1051 - DNA, 200 bp, Conyza canadensis
ccggctcggagtttcccaccaaggctcatcagatcaaaggtaggcaaatcagatggactggaaggcaccggcttcagatcaccatcccataacacaaaccgaggtgcagttggatcacccaacaccaaatcatccttcaatccactgtccaccaccatagtaagcataggatcggagggttgaaagctattaggaccttc

SEQ ID NO: 1052 - DNA, 200 bp, Conyza canadensis
gccttggtgggaaactccgagccggttttggggctcttggaatccgccctccacctccagaccgtgaggaatctgttgaagagtttgtccggcgtaatcttggtgatgaagtttttgaacgtttgattgaaccattttgctcaggtgtttacgcgggggatccatcaaaacttagtatgaaagcagcatttggaaaggtt

SEQ ID NO: 1053 - DNA, 200 bp, Conyza canadensis
aacctttccaaatgctgctttcatactaagttttgatggatcccccgcgtaaacacctgagcaaaatggttcaatcaaacgttcaaaaacttcatcaccaagattacgccggacaaactcttcaacagattcctcacggtctggaggtggagggcggattccaagagccccaaaaccggctcggagtttcccaccaaggc

SEQ ID NO: 1054 - DNA, 200 bp, Conyza canadensis
tatgaaagcagcatttggaaaggtttggaagctggagcaaaatggtggtagcattgttgggggagcatttaaagcaatccaagctaaaaataagagtaccaagcctcctcgagacccgagattaccaacaccgaagggccaaactgttggatcttttaggaagggacaagcaatgttgcctaatgccatctcaaaagggt

SEQ ID NO: 1055 - DNA, 200 bp, Conyza canadensis
acccttttgagatggcattaggcaacattgcttgtcccttcctaaaagatccaacagtttggcccttcggtgttggtaatctcgggtctcgaggaggcttggtactcttatttttagcttggattgctttaaatgctcccccaacaatgctaccaccattttgctccagcttccaaacctttccaaatgctgctttcata

SEQ ID NO: 1056 - DNA, 200 bp, Conyza canadensis
ttgcctaatgccatctcaaaagggttgggtagcagagtgaagttatcctgggagctcgtaggtatcactaaatctgagaatagagggtatagtttgacatatcgaacaccagatggattggaaagtctgcagactaaaactgttgtcatgactgttccatcctatgtggctagtgacttgttgcgtcctctttcggtgga

SEQ ID NO: 1057 - DNA, 200 bp, Conyza canadensis
tccaccgaaagaggacgcaacaagtcactagccacataggatggaacagtcatgacaacagttttagtctgcagactttccaatccatctggtgttcgatatgtcaaactataccctctattctcagatttagtgatacctacgagctcccaggataacttcactctgctacccaacccttttgagatggcattaggcaa

SEQ ID NO: 1058 - DNA, 200 bp, Conyza canadensis
acttgttgcgtcctctttcggtggaagcagcagatgctttgtcaaaattttattatcccccggttgcagctgtatctgtttcctatccaaaagaggcaattcgtgcggaccgtttgattgacggtcagctcaagggttttggtcagttgcatccacgaagtcagggcgtggagactctaggtaccatatacagttcgtct

SEQ ID NO: 1059 - DNA, 200 bp, Conyza canadensis
agacgaactgtatatggtacctagagtctccacgccctgacttcgtggatgcaactgaccaaaacccttgagctgaccgtcaatcaaacggtccgcacgaattgcctcttttggataggaaacagatacagctgcaaccgggggataataaaattttgacaaagcatctgctgcttccaccgaaagaggacgcaacaagt

SEQ ID NO: 1060 - DNA, 200 bp, Conyza canadensis
tctaggtaccatatacagttcgtctcttttccctaaccgtgctccacctggaagggttctgctcctgaactacattggaggggctacaaatcctggtattttatcaaagacggagagtcaaattgttgaagcagttgatcgcgacctacggaagatgctgataaatcctaaagcaggagagccattgaccttaggagtga

SEQ ID NO: 1061 - DNA, 200 bp, Conyza canadensis
tcactcctaaggtcaatggctctcctgctttaggatttatcagcatcttccgtaggtcgcgatcaactgcttcaacaatttgactctccgtctttgataaaataccaggatttgtagcccctccaatgtagttcaggagcagaacccttccaggtggagcacggttagggaaaagagacgaactgtatatggtacctaga

SEQ ID NO: 1062 - DNA, 200 bp, Conyza canadensis
ggagagccattgaccttaggagtgaaagtgtggcctcgagcgatcccacagtttctgattggtcattatgacattttagaggctgctaaatgtgctcttagtcttgctggataccggggtatgtttcttggagggaactatgtatctggtgtagctttaggtagatgtgtggagaatgcctatgaggttgcagccgatgt

SEQ ID NO: 1063 - DNA, 200 bp, Conyza canadensis
acatcggctgcaacctcataggcattctccacacatctacctaaagctacaccagatacatagttccctccaagaaacataccccggtatccagcaagactaagagcacatttagcagcctctaaaatgtcataatgaccaatcagaaactgtgggatcgctcgaggccacactttcactcctaaggtcaatggctctcc

SEQ ID NO: 1064 - DNA, 200 bp, Conyza canadensis
atgcctatgaggttgcagccgatgtaagtaattttttgtcacggggcgtgtacaagtaatacgtcactcttcggaaattagtgtttatgaggttagtaattaaagttttggcacaaggcatgtggaagtgaaaacgcggactttcagtgaagttagtcatctattctcaagcctcatggctaaatgtaattcgagttaat

SEQ ID NO: 1065 - DNA, 200 bp, Conyza canadensis
attaactcgaattacatttagccatgaggcttgagaatagatgactaacttcactgaaagtccgcgttttcacttccacatgccttgtgccaaaactttaattactaacctcataaacactaatttccgaagagtgacgtattacttgtacacgccccgtgacaaaaaattacttacatcggctgcaacctcataggcat

SEQ ID NO: 1066 - DNA, 200 bp, Conyza canadensis
cgtcaccatactgccacggtcgccacaccttcgtctctatcactatcaccgtcgcatcgcacggacatcatctagtcaatatttatttatgaggaatggagatatatctatactttcatattaaattaaactgcctatttttttcaactattctacctttgaaatgcctattataccctcctataaacaactatccattc

SEQ ID NO: 1067 - DNA, 200 bp, Conyza canadensis
gaatggatagttgtttataggagggtataataggcatttcaaaggtagaatagttgaaaaaaataggcagtttaatttaatatgaaagtatagatatatctccattcctcataaataaatattgactagatgatgtccgtgcgatgcgacggtgatagtgatagagacgaaggtgtggcgaccgtggcagtatggtgacg

SEQ ID NO: 1068 - DNA, 200 bp, Conyza canadensis
ccctcctataaacaactatccattctactcttttaattgattttctcgtactacccttccatctatttcccaatacttatccctaatctctaatcccctcctctcttgctgtcgccgaaaacctaatagaaaaattagtttcatttctacggcaactaccataaacctacaaaaagattggttttatctctccctcacca

SEQ ID NO: 1069 - DNA, 200 bp, Conyza canadensis
tggtgagggagagataaaaccaatctttttgtaggtttatggtagttgccgtagaaatgaaactaatttttctattaggttttcggcgacagcaagagaggaggggattagagattagggataagtattgggaaatagatggaagggtagtacgagaaaatcaattaaaagagtagaatggatagttgtttataggaggg

SEQ ID NO: 1070 - DNA, 200 bp, Conyza canadensis
gattggttttatctctccctcaccaccaccaccacaaatcacccattccttacaagctctcaaatcggttaggtgattttccattgaaatcgcttgtttttattttattttattatatctaatttcctaatttaaatccattgtttttgtatttttcccaattttctttttgaatttggtttgggttaatgttctgatca

SEQ ID NO: 1071 - DNA, 200 bp, Conyza canadensis
tgatcagaacattaacccaaaccaaattcaaaaagaaaattgggaaaaatacaaaaacaatggatttaaattaggaaattagatataataaaataaaataaaaacaagcgatttcaatggaaaatcacctaaccgatttgagagcttgtaaggaatgggtgatttgtggtggtggtggtgagggagagataaaaccaatc

SEQ ID NO: 1072 - DNA, 200 bp, Conyza canadensis
ttggtttgggttaatgttctgatcatccatgtattttgttcgtacattcacaaaagaaaaaggtaccgacacatttaatgatcacttttttaaaggtaccgtcgcatcatgtgggtacccatctagctagttgatgaataaattattagtattgttaaatttaagttttttgtttaatgagtaatttaagagtatgttta

SEQ ID NO: 1073 - DNA, 200 bp, Conyza canadensis
taaacatactcttaaattactcattaaacaaaaaacttaaatttaacaatactaataatttattcatcaactagctagatgggtacccacatgatgcgacggtacctttaaaaaagtgatcattaaatgtgtcggtacctttttcttttgtgaatgtacgaacaaaatacatggatgatcagaacattaacccaaaccaa

SEQ ID NO: 1074 - DNA, 200 bp, Conyza canadensis
aatgagtaatttaagagtatgtttaaatttgggttaaaaaaaaaagaaaaaaaaagtaaatgtgtattgatttgtaagttgtaaccgtctaatattataaaaagaaaaagagaaaccactcctatataaaacagtcaagcctcttgtatcattaaccgggttgatttaagagcgaactttgatcgaattttgggttttcg

SEQ ID NO: 1075 - DNA, 200 bp, Conyza canadensis
cgaaaacccaaaattcgatcaaagttcgctcttaaatcaacccggttaatgatacaagaggcttgactgttttatataggagtggtttctctttttctttttataatattagacggttacaacttacaaatcaatacacatttactttttttttcttttttttttaacccaaatttaaacatactcttaaattactcatt

SEQ ID NO: 1076 - DNA, 200 bp, Conyza canadensis
actttgatcgaattttgggttttcgaatttgctttccatccacatcgatatctgcccaagtaagaaaccctcgttcctgtctctctttaatttacatctccatgtgcttttcgatcctaattataaatatgcggataaccgcagcattactacccgacgcccaaaggaagaggaaaaagtcgtcgtcaaaggcagatcaa

SEQ ID NO: 1077 - DNA, 200 bp, Conyza canadensis
ttgatctgcctttgacgacgactttttcctcttcctttgggcgtcgggtagtaatgctgcggttatccgcatatttataattaggatcgaaaagcacatggagatgtaaattaaagagagacaggaacgagggtttcttacttgggcagatatcgatgtggatggaaagcaaattcgaaaacccaaaattcgatcaaagt

SEQ ID NO: 1078 - DNA, 200 bp, Conyza canadensis
aaagtcgtcgtcaaaggcagatcaacaaatattgatatattgataataatgtaatagaatatgagaggcttccagccaagtccgcatgtcgtttcaagtctgtttccaaacactggaattcgttcctatccacacgtatgtttggaccaccagctccatcacatgaacaaatcctataaacttctcttacttgaccagct

SEQ ID NO: 1079 - DNA, 200 bp, Conyza canadensis
agctggtcaagtaagagaagtttataggatttgttcatgtgatggagctggtggtccaaacatacgtgtggataggaacgaattccagtgtttggaaacagacttgaaacgacatgcggacttggctggaagcctctcatattctattacattattatcaatatatcaatatttgttgatctgcctttgacgacgacttt

SEQ ID NO: 1080 - DNA, 200 bp, Conyza canadensis
ataaacttctcttacttgaccagctagccccctgtagataaggatttatgcagcaaacccctcaaccacgtacggttccattaccgtcggttttaatcgactggaggaagccgatcctagatttaattcgcttgtaggatggattggtatgtgtagccgatccttgatctatatttcaatttcactggctaggtgtaggc

SEQ ID NO: 1081 - DNA, 200 bp, Conyza canadensis
gcctacacctagccagtgaaattgaaatatagatcaaggatcggctacacataccaatccatcctacaagcgaattaaatctaggatcggcttcctccagtcgattaaaaccgacggtaatggaaccgtacgtggttgaggggtttgctgcataaatccttatctacagggggctagctggtcaagtaagagaagtttat

SEQ ID NO: 1082 - DNA, 200 bp, Conyza canadensis
tcaatttcactggctaggtgtaggcattattattaagcaatgtgatcgattgatggctaattcaggcgtttgaattcaacttttcattagtcaagtaattattctcaagtttatatattaatagtatatatacgatatcatagtataatatacaaaataaaatctatccaaaaggaataaaatctttggaaaggaataaa

SEQ ID NO: 1083 - DNA, 200 bp, Conyza canadensis
tttattcctttccaaagattttattccttttggatagattttattttgtatattatactatgatatcgtatatatactattaatatataaacttgagaataattacttgactaatgaaaagttgaattcaaacgcctgaattagccatcaatcgatcacattgcttaataataatgcctacacctagccagtgaaattga

SEQ ID NO: 1084 - DNA, 200 bp, Conyza canadensis
aataaaatctttggaaaggaataaaatctatccaaaaagaataaaatctatccaaaaggaataaaatctttctaaagatttcggacattcactataaatagtgacagcagatgagatggaaagaaaaaaagaaaaaaaggaacaagaatactcctttggagagaatacttgaactctcatccctcaaatcattgttaaca

SEQ ID NO: 1085 - DNA, 200 bp, Conyza canadensis
tgttaacaatgatttgagggatgagagttcaagtattctctccaaaggagtattcttgttcctttttttctttttttctttccatctcatctgctgtcactatttatagtgaatgtccgaaatctttagaaagattttattccttttggatagattttattctttttggatagattttattcctttccaaagattttatt

SEQ ID NO: 1086 - DNA, 200 bp, Conyza canadensis
ctcatccctcaaatcattgttaacataatcactaccctcataggattggatggcgtaaaaccgtatacgtaatacggttaccagcagggatcgccacccaaatatcctaatcttcctcacaccttcccatgctaggtggcatgggacccacataactctctttatttatataatgatattagattacatactccttgaac

SEQ ID NO: 1087 - DNA, 200 bp, Conyza canadensis
gttcaaggagtatgtaatctaatatcattatataaataaagagagttatgtgggtcccatgccacctagcatgggaaggtgtgaggaagattaggatatttgggtggcgatccctgctggtaaccgtattacgtatacggttttacgccatccaatcctatgagggtagtgattatgttaacaatgatttgagggatgag

SEQ ID NO: 1088 - DNA, 200 bp, Conyza canadensis
atattagattacatactccttgaaccgtaagtgttaatcgacgtatcatcatatatacactaatatctatgttaaataattaataaacaaaatatgacacataaaatttttgcgagatatttttggcgaagcattgcacaaaaagcagcaaggctaggatatttttggcccacaatgtaccgcgatgcaacaaagattgt

SEQ ID NO: 1089 - DNA, 200 bp, Conyza canadensis
acaatctttgttgcatcgcggtacattgtgggccaaaaatatcctagccttgctgctttttgtgcaatgcttcgccaaaaatatctcgcaaaaattttatgtgtcatattttgtttattaattatttaacatagatattagtgtatatatgatgatacgtcgattaacacttacggttcaaggagtatgtaatctaatat

SEQ ID NO: 1090 - DNA, 200 bp, Conyza canadensis
tgtaccgcgatgcaacaaagattgtcgacaattgtgataattgccaatgccatgctcctatcatacgtcaaccccaacacgacttgacaagtatttcaagtccatggccgttctatcaatggggaacagatatcgtaggaccattcccagaagcaccaggaaaagtgaaatttttggtagtcgcaatcgactattttact

SEQ ID NO: 1091 - DNA, 200 bp, Conyza canadensis
agtaaaatagtcgattgcgactaccaaaaatttcacttttcctggtgcttctgggaatggtcctacgatatctgttccccattgatagaacggccatggacttgaaatacttgtcaagtcgtgttggggttgacgtatgataggagcatggcattggcaattatcacaattgtcgacaatctttgttgcatcgcggtaca

SEQ ID NO: 1092 - DNA, 200 bp, Conyza canadensis
ggtagtcgcaatcgactattttactaaattggcagaagcagagccactggcaacaataactggacataaaatactcaagttcgtatggcgcaacattgtatgtcgttatggaattccaggaattatcatcagtgacaacggaaagcaattcgcaaataacccatttcgggagtggtgtgaagagcttaaaataagacaac

SEQ ID NO: 1093 - DNA, 200 bp, Conyza canadensis
gttgtcttattttaagctcttcacaccactcccgaaatgggttatttgcgaattgctttccgttgtcactgatgataattcctggaattccataacgacatacaatgttgcgccatacgaacttgagtattttatgtccagttattgttgccagtggctctgcttctgccaatttagtaaaatagtcgattgcgactacc

SEQ ID NO: 1094 - DNA, 200 bp, Conyza canadensis
ttaggtggaatgcagacacttacaaatgcactgagcaaagaagttggacaacatgaacttaatcttcaatccaaggtgcttgaaatgtcctatagctgtgatgataacactactgggaattggtcgatctattgtgctccagatcagaacaaacaattaaatcagcaaccttttgatgctgtgatcatgactgccccact

SEQ ID NO: 1095 - DNA, 200 bp, Conyza canadensis
agtggggcagtcatgatcacagcatcaaaaggttgctgatttaattgtttgttctgatctggagcacaatagatcgaccaattcccagtagtgttatcatcacagctataggacatttcaagcaccttggattgaagattaagttcatgttgtccaacttctttgctcagtgcatttgtaagtgtctgcattccacctaa

SEQ ID NO: 1096 - DNA, 200 bp, Conyza canadensis
atgctgtgatcatgactgccccacttggcaatgtgaaagaaatgaagattacaaagacaggaagtctgttcctgctcaattttatacctgagcttagttatatgccagtttcagtcataatctctacattcaagaaagagaatgtgaagcggccccttgagggatttggaatgcttgttcctgccaaggagcaggaaaat

SEQ ID NO: 1097 - DNA, 200 bp, Conyza canadensis
attttcctgctccttggcaggaacaagcattccaaatccctcaaggggccgcttcacattctctttcttgaatgtagagattatgactgaaactggcatataactaagctcaggtataaaattgagcaggaacagacttcctgtctttgtaatcttcatttctttcacattgccaagtggggcagtcatgatcacagcat

SEQ ID NO: 1098 - DNA, 200 bp, Conyza canadensis
tgttcctgccaaggagcaggaaaatggtttgaagacgttaggcactctcttttcttccatgatgtttccagatcgtgcccctgaagacttgtatctttataccacctttgttgggggaagtcgaaacaaagaactggccaatgcttcgagggatgagttgaagcagatagtaacttctgacctcagacagttgcttggag

SEQ ID NO: 1099 - DNA, 200 bp, Conyza canadensis
ctccaagcaactgtctgaggtcagaagttactatctgcttcaactcatccctcgaagcattggccagttctttgtttcgacttcccccaacaaaggtggtataaagatacaagtcttcaggggcacgatctggaaacatcatggaagaaaagagagtgcctaacgtcttcaaaccattttcctgctccttggcaggaaca

SEQ ID NO: 1100 - DNA, 200 bp, Digitaria sanguinalis
acctaatgccatctcaaaaagcttgggtagcagagtgaaattatcatggaagctaataaatatctcaaagttggagaatagaggttataatttgacttacgaaacaccaaatggatttgcaagtctgcaaactaaaactgttgtcatgactgttccttcctacgtggcgagtgacttgttgcgtcctctttcgtcggaag

SEQ ID NO: 1101 - DNA, 200 bp, Digitaria sanguinalis
cttccgacgaaagaggacgcaacaagtcactcgccacgtaggaaggaacagtcatgacaacagttttagtttgcagacttgcaaatccatttggtgtttcgtaagtcaaattataacctctattctccaactttgagatatttattagcttccatgataatttcactctgctacccaagctttttgagatggcattaggt

SEQ ID NO: 1102 - DNA, 200 bp, Digitaria sanguinalis
ttgttgcgtcctctttcgtcggaagcagctgaggctttgtccaaattttattaccctccagttgcagctgtatctgtttcctatccaaaagaggcgattcgtgctgaccgtttgatcgatggtcaacttaagggttttggtcaattacatccaagaagtcaaggcgttgagactttaggtaccatctatagttcatccct

SEQ ID NO: 1103 - DNA, 200 bp, Digitaria sanguinalis
agggatgaactatagatggtacctaaagtctcaacgccttgacttcttggatgtaattgaccaaaacccttaagttgaccatcgatcaaacggtcagcacgaatcgcctcttttggataggaaacagatacagctgcaactggagggtaataaaatttggacaaagcctcagctgcttccgacgaaagaggacgcaacaa

SEQ ID NO: 1104 - DNA, 200 bp, Digitaria sanguinalis
cttgcgtctcacaaaaggcgcgagctggccggcccgctacttttgtgctttgtcttgtctccttcaggcttcagcaatggacaaacatccccctcaagtaaagcttaatagaaatcgattttgatgaacgaataaccatcattaacggcatcatggccatcgcttcgatgggatcagttgcttgcagagccggccaaagt

SEQ ID NO: 1105 - DNA, 200 bp, Digitaria sanguinalis
actttggccggctctgcaagcaactgatcccatcgaagcgatggccatgatgccgttaatgatggttattcgttcatcaaaatcgatttctattaagctttacttgagggggatgtttgtccattgctgaagcctgaaggagacaagacaaagcacaaaagtagcgggccggccagctcgcgccttttgtgagacgcaag

SEQ ID NO: 1106 - DNA, 200 bp, Digitaria sanguinalis
agttgcttgcagagccggccaaagtgggcacgtgagagccacgaggatacgcgagatgacgacgaccatggaggtggtttcgaactttcgatcgccgatttttattgcgtcagtttcacagccagagatgcttggcctagtacggctgacgatgagcgtttgtttagctcatctgaaggaatgtgttttgcctgttgcca

SEQ ID NO: 1107 - DNA, 200 bp, Digitaria sanguinalis
tggcaacaggcaaaacacattccttcagatgagctaaacaaacgctcatcgtcagccgtactaggccaagcatctctggctgtgaaactgacgcaataaaaatcggcgatcgaaagttcgaaaccacctccatggtcgtcgtcatctcgcgtatcctcgtggctctcacgtgcccactttggccggctctgcaagcaact

SEQ ID NO: 1108 - DNA, 200 bp, Digitaria sanguinalis
aaggaatgtgttttgcctgttgccaccaagattagcgtccttttcttttatcgaattcgggtcaccatttccactattaatcaaagatatagtttctatattttttctcattaatccacagtaccttttatttcagtagttattattgcatccatacttcaccagtacggcaccctttgcaatctctgcctacactccat

SEQ ID NO: 1109 - DNA, 200 bp, Digitaria sanguinalis
atggagtgtaggcagagattgcaaagggtgccgtactggtgaagtatggatgcaataataactactgaaataaaaggtactgtggattaatgagaaaaaatatagaaactatatctttgattaatagtggaaatggtgacccgaattcgataaaagaaaaggacgctaatcttggtggcaacaggcaaaacacattcctt

SEQ ID NO: 1110 - DNA, 200 bp, Digitaria sanguinalis
tttgcaatctctgcctacactccattacctcgaagaatagtgcactacagatgcaataaacacccacctcaccgactgctcgtaggtgcaccagtacactacatttgctgctgcatgctggtcgccatcatccttcctgcctgcaggaagcagcagggtgtctgggatctgcatcatgccgggcgcacaagaggaacaga

SEQ ID NO: 1111 - DNA, 200 bp, Digitaria sanguinalis
tctgttcctcttgtgcgcccggcatgatgcagatcccagacaccctgctgcttcctgcaggcaggaaggatgatggcgaccagcatgcagcagcaaatgtagtgtactggtgcacctacgagcagtcggtgaggtgggtgtttattgcatctgtagtgcactattcttcgaggtaatggagtgtaggcagagattgcaaa

SEQ ID NO: 1112 - DNA, 200 bp, Digitaria sanguinalis
atgccgggcgcacaagaggaacagacgtgccaataaaagggctagcaacgcaacgaggggagggcccctttttttcgtgttacctcccgtcctgtgcatgagttgtcgtgtgtaacagacgtgcttggtgataaagcgtaggtgaagaagtggcctcccctgtgtcccctcccttctcaggaacgtttcgtcatcttttc

SEQ ID NO: 1113 - DNA, 200 bp, Digitaria sanguinalis
gaaaagatgacgaaacgttcctgagaagggaggggacacaggggaggccacttcttcacctacgctttatcaccaagcacgtctgttacacacgacaactcatgcacaggacgggaggtaacacgaaaaaaaggggccctcccctcgttgcgttgctagcccttttattggcacgtctgttcctcttgtgcgcccggcat

SEQ ID NO: 1114 - DNA, 200 bp, Digitaria sanguinalis
ctcaggaacgtttcgtcatcttttcactgaaaacgggcgcgtgctaactgccgcatctgtgagttgaatggttgattggagagaaattaggtgtgcaatcaccacttgggcggcaatcgtgtgcacttacttttggttgggtgtcagatcaacaacaggggtttcttggggaaatgtttccaaatgtacttctcaaaatt

SEQ ID NO: 1115 - DNA, 200 bp, Digitaria sanguinalis
aattttgagaagtacatttggaaacatttccccaagaaacccctgttgttgatctgacacccaaccaaaagtaagtgcacacgattgccgcccaagtggtgattgcacacctaatttctctccaatcaaccattcaactcacagatgcggcagttagcacgcgcccgttttcagtgaaaagatgacgaaacgttcctgag

SEQ ID NO: 1116 - DNA, 200 bp, Digitaria sanguinalis
gtttccaaatgtacttctcaaaattacttctagtgtacacatgttgaatttcagttcaaatttatttacaagaataataaacaaagaagaaaattggcaaacaacattcataaaaaatggaatgaaaagagaaatgcatccttcttttgaagataaatagtcaaatgccatgtttgtttcgttcacaaacagaaaaatga

SEQ ID NO: 1117 - DNA, 200 bp, Digitaria sanguinalis
tcatttttctgtttgtgaacgaaacaaacatggcatttgactatttatcttcaaaagaaggatgcatttctcttttcattccattttttatgaatgttgtttgccaattttcttctttgtttattattcttgtaaataaatttgaactgaaattcaacatgtgtacactagaagtaattttgagaagtacatttggaaac

SEQ ID NO: 1118 - DNA, 200 bp, Digitaria sanguinalis
gtttcgttcacaaacagaaaaatgatttcatgattgcaccgcaagagtggatgaatatatataggtctacagttgaacaccaatttggaagaaaaattcatgaggcagaagtaaaatcgattatttccttgagcttccgcattgcatctcccaaaagaaaaccattaaatactactagcaagttctagtacagtccctac

SEQ ID NO: 1119 - DNA, 200 bp, Digitaria sanguinalis
gtagggactgtactagaacttgctagtagtatttaatggttttcttttgggagatgcaatgcggaagctcaaggaaataatcgattttacttctgcctcatgaatttttcttccaaattggtgttcaactgtagacctatatatattcatccactcttgcggtgcaatcatgaaatcatttttctgtttgtgaacgaaac

SEQ ID NO: 1120 - DNA, 200 bp, Digitaria sanguinalis
tagcaagttctagtacagtccctactaattaaacatcagcataattatccttcttatactcactcgggttttttcttatatgtcgtattagtttcatcttaagtcaaacttgtcaaaatttgaccaagtttatacaaaagtataacaataactatactaccaaacttatatggtatcacaatatatttcattagtaggga

SEQ ID NO: 1121 - DNA, 200 bp, Digitaria sanguinalis
tccctactaatgaaatatattgtgataccatataagtttggtagtatagttattgttatacttttgtataaacttggtcaaattttgacaagtttgacttaagatgaaactaatacgacatataagaaaaaacccgagtgagtataagaaggataattatgctgatgtttaattagtagggactgtactagaacttgcta

SEQ ID NO: 1122 - DNA, 200 bp, Digitaria sanguinalis
tcacaatatatttcattagtagggactgtctcgccggtcggggaaattaaacgccccccgatccgtcaccgtgacctgccctcctccccgcccgggcagatcgggccatcgcctccatcggggcacggctaggtacctgaaaacgatcgagcaaagcggccggttcgtttcgttcgtagcgagaggcatttgctgccagt

SEQ ID NO: 1123 - DNA, 200 bp, Digitaria sanguinalis
actggcagcaaatgcctctcgctacgaacgaaacgaaccggccgctttgctcgatcgttttcaggtacctagccgtgccccgatggaggcgatggcccgatctgcccgggcggggaggagggcaggtcacggtgacggatcggggggcgtttaatttccccgaccggcgagacagtccctactaatgaaatatattgtga

SEQ ID NO: 1124 - DNA, 200 bp, Digitaria sanguinalis
gtagcgagaggcatttgctgccagttcccggcgcgggacacgcgcgcgcgaaatggcggtgtcgagagggagggaggcgtcgctttcggcgggcgggggcgtgttccctggctgtagcccggcggcgcggcaggcctcgcgcgggtgtcaataccggcccggcggattaggtccccgtctttatgaccggcgcgcgcgca

SEQ ID NO: 1125 - DNA, 200 bp, Digitaria sanguinalis
tgcgcgcgcgccggtcataaagacggggacctaatccgccgggccggtattgacacccgcgcgaggcctgccgcgccgccgggctacagccagggaacacgcccccgcccgccgaaagcgacgcctccctccctctcgacaccgccatttcgcgcgcgcgtgtcccgcgccgggaactggcagcaaatgcctctcgctac

SEQ ID NO: 1126 - DNA, 200 bp, Digitaria sanguinalis
cgtctttatgaccggcgcgcgcgcacccttgcggtgcccgtgcgttgacgacgctgccaccgcacgtcccccttcttcattccatggcagggacgacgacgctagctatagctgcacgtacgcggtcgatcgagtggctatggcttggtctctactgcacgccatgccgcccggcctcccaccacaataactcgtgtgcc

SEQ ID NO: 1127 - DNA, 200 bp, Digitaria sanguinalis
ggcacacgagttattgtggtgggaggccgggcggcatggcgtgcagtagagaccaagccatagccactcgatcgaccgcgtacgtgcagctatagctagcgtcgtcgtccctgccatggaatgaagaagggggacgtgcggtggcagcgtcgtcaacgcacgggcaccgcaagggtgcgcgcgcgccggtcataaagacg

SEQ ID NO: 1128 - DNA, 200 bp, Digitaria sanguinalis
ctcccaccacaataactcgtgtgccggcccggcacggcgcgggccgtggtggaactgatcgcgtcgcgcattgatcatcatgcgtgggggcgtcggggcgacggctcgagcgtgcgcacatgattgtgcgtgtcaggatcccagacgctagctacagcttgctgctggtccatccagtgccctacgtggacgccgatcgc

SEQ ID NO: 1129 - DNA, 200 bp, Digitaria sanguinalis
gcgatcggcgtccacgtagggcactggatggaccagcagcaagctgtagctagcgtctgggatcctgacacgcacaatcatgtgcgcacgctcgagccgtcgccccgacgcccccacgcatgatgatcaatgcgcgacgcgatcagttccaccacggcccgcgccgtgccgggccggcacacgagttattgtggtgggag

SEQ ID NO: 1130 - DNA, 200 bp, Digitaria sanguinalis
agtgccctacgtggacgccgatcgctgtgtgttggtgtgtggggtgatgatgatggcggatggatggagtcatggaggcactgcggggctcacaggagattttggtgggtggtggacgcatccgtcgcgtcgcccccggcgctcgagtgcaccccgtaccaacccaacacgtccgctgtcgtggagacgccggagggcgc

SEQ ID NO: 1131 - DNA, 200 bp, Digitaria sanguinalis
gcgccctccggcgtctccacgacagcggacgtgttgggttggtacggggtgcactcgagcgccgggggcgacgcgacggatgcgtccaccacccaccaaaatctcctgtgagccccgcagtgcctccatgactccatccatccgccatcatcatcaccccacacaccaacacacagcgatcggcgtccacgtagggcact

SEQ ID NO: 1132 - DNA, 200 bp, Digitaria sanguinalis
ctgtcgtggagacgccggagggcgcatgaaatcattgttaattttctcttgtgtgttttttttaaaaaaattataataacaaaagatgcatgctcccttcttctttgattaactaatcgatcagctagctaactcacacattgtccttcctgcaagtagcgcatgtatatttatgctcaactatatgggtatatactttt

SEQ ID NO: 1133 - DNA, 200 bp, Digitaria sanguinalis
aaaagtatatacccatatagttgagcataaatatacatgcgctacttgcaggaaggacaatgtgtgagttagctagctgatcgattagttaatcaaagaagaagggagcatgcatcttttgttattataatttttttaaaaaaaacacacaagagaaaattaacaatgatttcatgcgccctccggcgtctccacgacag

SEQ ID NO: 1134 - DNA, 200 bp, Digitaria sanguinalis
gacatcctgcgtccactttcaagtgatgctgcagatgccctttcaagattctattatccaccagttggtgctgtgactatttcatatccaaaggaagcaattagaaaggaatgcttgattgatggggagctccagggttttggccagttgcatccacgtagtcaaggagttgagacattaggaacaatatacagctcatc

SEQ ID NO: 1135 - DNA, 200 bp, Digitaria sanguinalis
gatgagctgtatattgttcctaatgtctcaactccttgactacgtggatgcaactggccaaaaccctggagctccccatcaatcaagcattcctttctaattgcttcctttggatatgaaatagtcacagcaccaactggtggataatagaatcttgaaagggcatctgcagcatcacttgaaagtggacgcaggatgtc

SEQ ID NO: 1136 - DNA, 200 bp, Digitaria sanguinalis
cattaggaacaatatacagctcatcactcttcccaaatcgtgctcctgctggaagggtattacttctaaactatataggaggtgctacaaacactgggattgtctccaagagtgaaagtgagctggtagaagcagttgaccgtgaccttaggaaaatgctcatcaaccctagagcagtggaccctttagtccttggtgtc

SEQ ID NO: 1137 - DNA, 200 bp, Digitaria sanguinalis
gacaccaaggactaaagggtccactgctctagggttgatgagcattttcctaaggtcacggtcaactgcttctaccagctcactttcactcttggagacaatcccagtgtttgtagcacctcctatatagtttagaagtaatacccttccagcaggagcacgatttgggaagagtgatgagctgtatattgttcctaatg

SEQ ID NO: 1138 - DNA, 200 bp, Digitaria sanguinalis
agtggaccctttagtccttggtgtccgagtgtggccacaagccatacctcagttcctggtaggacatcttgatcttctggaggttgcaaaatctgccttgggccgaggtggctatgatgggctcttcctaggagggaattatgtagcaggagttgccctgggccgatgcgtggagggtgcctatgaaagcgcctcgcaaa

SEQ ID NO: 1139 - DNA, 200 bp, Digitaria sanguinalis
tttgcgaggcgctttcataggcaccctccacgcatcggcccagggcaactcctgctacataattccctcctaggaagagcccatcatagccacctcggcccaaggcagattttgcaacctccagaagatcaagatgtcctaccaggaactgaggtatggcttgtggccacactcggacaccaaggactaaagggtccact

SEQ ID NO: 1140 - DNA, 200 bp, Digitaria sanguinalis
ggtgcctatgaaagcgcctcgcaaatatctgacttcttgaccaagtatgcctacaagtgatgaaagaagtcgagctgctcgttgttttgcatagatgaggtgagaccaggagtggcacaaagtttacaaggattttttttttcatcttatttcgtaaattgtacttctgatctttttccctgttagtaattagttagact

SEQ ID NO: 1141 - DNA, 200 bp, Digitaria sanguinalis
agtctaactaattactaacagggaaaaagatcagaagtacaatttacgaaataagatgaaaaaaaaaatccttgtaaactttgtgccactcctggtctcacctcatctatgcaaaacaacgagcagctcgacttctttcatcacttgtaggcatacttggtcaagaagtcagatatttgcgaggcgctttcataggcacc

SEQ ID NO: 1142 - DNA, 200 bp, Digitaria sanguinalis
taggtatttctttcaactgagtcttaagctacaacatctacagattattgtttttcttttgtggtgtgatttttcattctagtatgtattatgtcttcttttgttgaatccaagatatgaatcaaaatagtggtggtatgcttttgtaggaacaatatacagctcatcactcttcccaaatcgtgctcctgctggaaggg

SEQ ID NO: 1143 - DNA, 200 bp, Digitaria sanguinalis
cccttccagcaggagcacgatttgggaagagtgatgagctgtatattgttcctacaaaagcataccaccactattttgattcatatcttggattcaacaaaagaagacataatacatactagaatgaaaaatcacaccacaaaagaaaaacaataatctgtagatgttgtagcttaagactcagttgaaagaaataccta

SEQ ID NO: 1144 - DNA, 200 bp, Digitaria sanguinalis
ccaaatcgtgctcctgctggaagggtgttacttctaaactatataggaggtgctacaaacactggaattgtttccaaggttagtaattctctgtcgaacttattgccttgagttttgtgttcatgatgttttgactgtaaaaagaaaattggcattctttaataatcaacgtaagcagtattttaaaaagaaagttggca

SEQ ID NO: 1145 - DNA, 200 bp, Digitaria sanguinalis
tgccaactttctttttaaaatactgcttacgttgattattaaagaatgccaattttctttttacagtcaaaacatcatgaacacaaaactcaaggcaataagttcgacagagaattactaaccttggaaacaattccagtgtttgtagcacctcctatatagtttagaagtaacacccttccagcaggagcacgatttgg

SEQ ID NO: 1146 - DNA, 200 bp, Digitaria sanguinalis
cagtattttaaaaagaaagttggcattttaataatcaatatcaacttgtaactagattgcttattattggctattattatttaggtgggacccgcagactatttaggtgtggaacccatgtgggacccgcatactatttaggcgggacccacgcatattcagacacactatttagagtggaacctacaataatgttaagc

SEQ ID NO: 1147 - DNA, 200 bp, Digitaria sanguinalis
gcttaacattattgtaggttccactctaaatagtgtgtctgaatatgcgtgggtcccgcctaaatagtatgcgggtcccacatgggttccacacctaaatagtctgcgggtcccacctaaataataatagccaataataagcaatctagttacaagttgatattgattattaaaatgccaactttctttttaaaatactg

SEQ ID NO: 1148 - DNA, 200 bp, Digitaria sanguinalis
agtggaacctacaataatgttaagcgtctacgttatttaaaaaattattgataattgttttcattctttgcagtataaaatatatttatttttttctatgtataaaaataatctctaactttgtatactacattcgtttgtgatagttctaatactttttgtactttgctttcatttcataaatttgaaaaataagattg

SEQ ID NO: 1149 - DNA, 200 bp, Digitaria sanguinalis
caatcttatttttcaaatttatgaaatgaaagcaaagtacaaaaagtattagaactatcacaaacgaatgtagtatacaaagttagagattatttttatacatagaaaaaaataaatatattttatactgcaaagaatgaaaacaattatcaataattttttaaataacgtagacgcttaacattattgtaggttccact

SEQ ID NO: 1150 - DNA, 200 bp, Digitaria sanguinalis
ttcataaatttgaaaaataagattgaattatacattcgttacaaaatgtatcttttttctattaaaaattaaaaattagtgtaacataacacgtcactccattagctatttctactaccacttatatagtgcttaaatgattattatgattaaaaaatttgtctaaatttaatattgcattgagtatagtaagataacaa

SEQ ID NO: 1151 - DNA, 200 bp, Digitaria sanguinalis
ttgttatcttactatactcaatgcaatattaaatttagacaaattttttaatcataataatcatttaagcactatataagtggtagtagaaatagctaatggagtgacgtgttatgttacactaatttttaatttttaatagaaaaaagatacattttgtaacgaatgtataattcaatcttatttttcaaatttatgaa

SEQ ID NO: 1152 - DNA, 200 bp, Digitaria sanguinalis
tgcattgagtatagtaagataacaaatttgtattacatcattattttagtttaacatcttctatatagacgcacatcgctcgtcaacccaactagtattcctaatgatgccatctcaattgcagagtgaaagtgagctggtagaagcagttgatcgtgacctcaggaaaatgctcatcgaccctagagcagtggaccctt

SEQ ID NO: 1153 - DNA, 200 bp, Digitaria sanguinalis
aagggtccactgctctagggtcgatgagcattttcctgaggtcacgatcaactgcttctaccagctcactttcactctgcaattgagatggcatcattaggaatactagttgggttgacgagcgatgtgcgtctatatagaagatgttaaactaaaataatgatgtaatacaaatttgttatcttactatactcaatgca

SEQ ID NO: 1154 - DNA, 200 bp, Digitaria sanguinalis
tggaggattctttcaacgtcattttgggaaggaggttgttgagtatctcattgatccagttgttgcgggaacaagcggtggagatcctgaatcactttcaatgcgttatgcgtttcctgagttatgggatttagagagaaggttcggttcaatcatttctggggcatttctgtcaatgttatcttccagaggtgggaaaa

SEQ ID NO: 1155 - DNA, 200 bp, Digitaria sanguinalis
ttttcccacctctggaagataacattgacagaaatgccccagaaatgattgaaccgaaccttctctctaaatcccataactcaggaaacgcataacgcattgaaagtgattcaggatctccaccgcttgttcccgcaacaactggatcaatgagatactcaacaacctccttcccaaaatgacgttgaaagaatcctcca

SEQ ID NO: 1156 - DNA, 200 bp, Digitaria sanguinalis
atgttatcttccagaggtgggaaaaggaaaccttctggaaacagcaaacgtaggcgtggttctttttcttttttgggtgggatgcagacgctcactgatgcactatgcaaagagattggaccccatgaatttaatctccaatcaaaggttcttgaaatgtcctacagctgcgatgataacgtggttggtaattggtcaat

SEQ ID NO: 1157 - DNA, 200 bp, Digitaria sanguinalis
attgaccaattaccaaccacgttatcatcgcagctgtaggacatttcaagaacctttgattggagattaaattcatggggtccaatctctttgcatagtgcatcagtgagcgtctgcatcccacccaaaaaagaaaaagaaccacgcctacgtttgctgtttccagaaggtttccttttcccacctctggaagataacat

SEQ ID NO: 1158 - DNA, 121 bp, Euphorbia heterophylla; identical to SEQ ID NO: 47

SEQ ID NO: 1159 - DNA, 121 bp, Euphorbia heterophylla
aaatttaaaaatttattagtgtaaaatatgggtgtgcaaatggttttggtaaccgcatttccgaatcgaatcagactgagttattaatttggtttggttactctgaaaattcggttcggtt

SEQ ID NO: 1160 - DNA, 200 bp, Euphorbia heterophylla
acaggttgtgcattccacccagaaacgtcagcgtggttcattttcgtttctgggtggaatgcagactcttcctgacaggttgtgcaaagagcttgcaaaagacgagcttagacttgagtcaaaggttttgtctttgtcttataatcacgattctagatcggcgttagacaattggtctgtctcttttgcttctaagggca

SEQ ID NO: 1161 - DNA, 200 bp, Euphorbia heterophylla
tgcccttagaagcaaaagagacagaccaattgtctaacgccgatctagaatcgtgattataagacaaagacaaaacctttgactcaagtctaagctcgtcttttgcaagctctttgcacaacctgtcaggaagagtctgcattccacccagaaacgaaaatgaaccacgctgacgtttctgggtggaatgcacaacctgt

SEQ ID NO: 1162 - DNA, 200 bp, Euphorbia heterophylla
tctgtctcttttgcttctaagggcaacaaacgtatgcaagactcgtcatatgatgccgtcattatgacggcaccactttgcaacctcaaagaaatgaggatcacaaaaggcagaaatcacttcctgttggactttattcccgaggtaatttatatgccactgtcggtcattattacgacgttcaagaaggagaatgtcaa

SEQ ID NO: 1163 - DNA, 200 bp, Euphorbia heterophylla
ttgacattctccttcttgaacgtcgtaataatgaccgacagtggcatataaattacctcgggaataaagtccaacaggaagtgatttctgccttttgtgatcctcatttctttgaggttgcaaagtggtgccgtcataatgacggcatcatatgacgagtcttgcatacgtttgttgcccttagaagcaaaagagacaga

SEQ ID NO: 1164 - DNA, 200 bp, Euphorbia heterophylla
acttttttacatgttcagggggttatttgaaacatttgaaagttcaaggggtaactagccctttttgaacaagttcaggggttttcatgtattaggcctctatttaatattggatgctccaattggacacctgagctttatgttgtcataattagtagtagatatagctttcttttaattttcacgtgtttttttcgtgt

SEQ ID NO: 1165 - DNA, 200 bp, Euphorbia heterophylla
acacgaaaaaaacacgtgaaaattaaaagaaagctatatctactactaattatgacaacataaagctcaggtgtccaattggagcatccaatattaaatagaggcctaatacatgaaaacccctgaacttgttcaaaaagggctagttaccccttgaactttcaaatgtttcaaataaccccctgaacatgtaaaaaagt

SEQ ID NO: 1166 - DNA, 200 bp, Euphorbia heterophylla
taattttcacgtgtttttttcgtgtaaatagaaagacagcgaacttgttgaagcagttgaccgtgatctgcgaaagatgctcataaatcccaatgcaaaggatccacttacacttggcgtaagagtgtggcctcaagccattccacagtttctgattggtcactacgatatcctagatacggcgaaaaatgcgttaagtg

SEQ ID NO: 1167 - DNA, 200 bp, Euphorbia heterophylla
cacttaacgcatttttcgccgtatctaggatatcgtagtgaccaatcagaaactgtggaatggcttgaggccacactcttacgccaagtgtaagtggatcctttgcattgggatttatgagcatctttcgcagatcacggtcaactgcttcaacaagttcgctgtctttctatttacacgaaaaaaacacgtgaaaatta

SEQ ID NO: 1168 - DNA, 200 bp, Euphorbia heterophylla
gatacggcgaaaaatgcgttaagtgaacaaggcttggaagggctgtttttagggggtaactatgtgtatggtgtagctttgggaaaatgtgttgaaggagcatatgaaactgcgtccagtgttactaatttcctaacccagtatacttataaatagtatctgatgagatttaagcaagagttcaattatgctgcggctaa

SEQ ID NO: 1169 - DNA, 200 bp, Euphorbia heterophylla
ttagccgcagcataattgaactcttgcttaaatctcatcagatactatttataagtatactgggttaggaaattagtaacactggacgcagtttcatatgctccttcaacacattttcccaaagctacaccatacacatagttaccccctaaaaacagcccttccaagccttgttcacttaacgcatttttcgccgtatc

SEQ ID NO: 1170 - DNA, 200 bp, Euphorbia heterophylla
aagagttcaattatgctgcggctaagtactgtgagtttattgagtagtgggtaaaaatgttgctttaggtctgttgtatttgtaatagttgcttcacgtttttcattaaggatggtgtattctctagttatgcattcttgttcatttagcaggcaaaacgagtttgatgtgcattcagaatatgttggcagttgattgac

SEQ ID NO: 1171 - DNA, 200 bp, Euphorbia heterophylla
gtcaatcaactgccaacatattctgaatgcacatcaaactcgttttgcctgctaaatgaacaagaatgcataactagagaatacaccatccttaatgaaaaacgtgaagcaactattacaaatacaacagacctaaagcaacatttttacccactactcaataaactcacagtacttagccgcagcataattgaactctt

SEQ ID NO: 1172 - DNA, 200 bp, Euphorbia heterophylla
agattagtgaatgatcacaacaaataccgtttgataagtccaattttttctttttttgcaagatttggttctattatagctggggcaattcagtcaaatttttcctcgaaaaaggataagagcaaggagacaaattcatcaagacataagaaacgtcagcgtggttcattttcgtttctgggtggaatgcaggtattaga

SEQ ID NO: 1173 - DNA, 200 bp, Euphorbia heterophylla
tctaatacctgcattccacccagaaacgaaaatgaaccacgctgacgtttcttatgtcttgatgaatttgtctccttgctcttatcctttttcgaggaaaaatttgactgaattgccccagctataatagaaccaaatcttgcaaaaaaagaaaaaattggacttatcaaacggtatttgttgtgatcattcactaatct

SEQ ID NO: 1174 - DNA, 200 bp, Euphorbia heterophylla
ttctgggtggaatgcaggtattagatgtaggatattacttatgaactctgaaatttgtatctaatatcacttttcttaaagcccctaaatgattttaatattaggattttctttttgtatctagctttattatttgctcgattttactcgttaaagctatgtttatttgttgagaagccttctagaggcgatacagattt

SEQ ID NO: 1175 - DNA, 200 bp, Euphorbia heterophylla
aaatctgtatcgcctctagaaggcttctcaacaaataaacatagctttaacgagtaaaatcgagcaaataataaagctagatacaaaaagaaaatcctaatattaaaatcatttaggggctttaagaaaagtgatattagatacaaatttcagagttcataagtaatatcctacatctaatacctgcattccacccagaa

SEQ ID NO: 1176 - DNA, 200 bp, Euphorbia heterophylla
agccttctagaggcgatacagattttcttagcttatgcaagtgattatcctatgaactatttatgttttcttttcccgaatctatttttctttgcagactcttcctgacaggttgtgcaaagagcttgctaaagacgagcttagacttgggtcaaaggttttgtctttgtcttataatcacgattctagatcggcgttag

SEQ ID NO: 1177 - DNA, 200 bp, Euphorbia heterophylla
ctaacgccgatctagaatcgtgattataagacaaagacaaaacctttgacccaagtctaagctcgtctttagcaagctctttgcacaacctgtcaggaagagtctgcaaagaaaaatagattcgggaaaagaaaacataaatagttcataggataatcacttgcataagctaagaaaatctgtatcgcctctagaaggct

SEQ ID NO: 1178 - DNA, 200 bp, Euphorbia heterophylla
aatcacgattctagatcggcgttagacaattggtctgtctcttttgcttctaagggcgacaaacgtatgcaaaactcgtcatatgatgctgtcattatgacggttagcaacttctttactgatgatataatgtttatcaattaatctttttgatatcgaaacgaaacaatttcattgtttactcagattcattatcactt

SEQ ID NO: 1179 - DNA, 200 bp, Euphorbia heterophylla
aagtgataatgaatctgagtaaacaatgaaattgtttcgtttcgatatcaaaaagattaattgataaacattatatcatcagtaaagaagttgctaaccgtcataatgacagcatcatatgacgagttttgcatacgtttgtcgcccttagaagcaaaagagacagaccaattgtctaacgccgatctagaatcgtgatt

SEQ ID NO: 1180 - DNA, 200 bp, Euphorbia heterophylla
tgtttactcagattcattatcacttctaaaatttcaggcaccactttgcaacctcaaagaaatgaggatcacaaaaggcagaaatcacttcccgttggactttattcccgaggtacccttcttgcaaatctattgacaagaatggatgtcaataattcaaccgaaaccatatgaactattgcaggtaatttatatgccac

SEQ ID NO: 1181 - DNA, 200 bp, Euphorbia heterophylla
gtggcatataaattacctgcaatagttcatatggtttcggttgaattattgacatccattcttgtcaatagatttgcaagaagggtacctcgggaataaagtccaacgggaagtgatttctgccttttgtgatcctcatttctttgaggttgcaaagtggtgcctgaaattttagaagtgataatgaatctgagtaaaca

SEQ ID NO: 1182 - DNA, 200 bp, Euphorbia heterophylla
attgcgtgattgtaggaggtggaatcactggtctctgcattgctcaggcacttgccactaagcaccggaatgttgctcccaacgttattgtcaccgaggctagagatcgcgtcggtggcaacatcaacaccgttgaaagggacggctatctctgggaagaggggcctaacagtttccagccctccgatcctatgctaacc

SEQ ID NO: 1183 - DNA, 200 bp, Euphorbia heterophylla
ggttagcataggatcggagggctggaaactgttaggcccctcttcccagagatagccgtccctttcaacggtgttgatgttgccaccgacgcgatctctagcctcggtgacaataacgttgggagcaacattccggtgcttagtggcaagtgcctgagcaatgcagagaccagtgattccacctcctacaatcacgcaat

SEQ ID NO: 1184 - DNA, 200 bp, Euphorbia heterophylla
ccagccctccgatcctatgctaaccatggcggtggatagtggtttgaaggatgacctagttttgggggatcctacagcgccacggtttgtattgtgggatgggcaattgaggccagttccttctaagccaagtgacttgccgttctttgatttgatgagcattggtggaaaactcagagctggttttggtgctcttggac

SEQ ID NO: 1185 - DNA, 200 bp, Euphorbia heterophylla
gtccaagagcaccaaaaccagctctgagttttccaccaatgctcatcaaatcaaagaacggcaagtcacttggcttagaaggaactggcctcaattgcccatcccacaatacaaaccgtggcgctgtaggatcccccaaaactaggtcatccttcaaaccactatccaccgccatggttagcataggatcggagggctgg

SEQ ID NO: 1186 - DNA, 200 bp, Euphorbia heterophylla
agagctggttttggtgctcttggacttcggcctccacctccaggacgtgaggaatcagttgaagagtttgtgcgccgcaaccttggagatgaagttttcgagcgtttgattgagccattttgttcaggtgtttatgcaggtgatcctgcaaaactcagcatgaaagcagcattcggaaaagtttggatgctggaacaaaa

SEQ ID NO: 1187 - DNA, 200 bp, Euphorbia heterophylla
ttttgttccagcatccaaacttttccgaatgctgctttcatgctgagttttgcaggatcacctgcataaacacctgaacaaaatggctcaatcaaacgctcgaaaacttcatctccaaggttgcggcgcacaaactcttcaactgattcctcacgtcctggaggtggaggccgaagtccaagagcaccaaaaccagctct

SEQ ID NO: 1188 - DNA, 200 bp, Euphorbia heterophylla
gaaaagtttggatgctggaacaaaatggaggcagtatcattggtggcacttttaaagcaatccaggaaaggaataaaaatcccaagcctcctcgagacccgcgtctaccaaaaccaaagggccaaacagtagggtcttttaggaagggactgactatgcttccagaggcaattgcatcaagtttgggtagtaatatcaag

SEQ ID NO: 1189 - DNA, 200 bp, Euphorbia heterophylla
cttgatattactacccaaacttgatgcaattgcctctggaagcatagtcagtcccttcctaaaagaccctactgtttggccctttggttttggtagacgcgggtctcgaggaggcttgggatttttattcctttcctggattgctttaaaagtgccaccaatgatactgcctccattttgttccagcatccaaacttttc

SEQ ID NO: 1190 - DNA, 200 bp, Euphorbia heterophylla
atcaagtttgggtagtaatatcaagttatcttggaagcttctgggtatctctaaattggacaatcgggagtacagtttaacatatgaaacacctgaaggatcagttactgtgcagagcaagagtgtcgtacttacaattccatcccatattgccagcaatatcctgaatcctctttctacaactgctgctgaggcactgt

SEQ ID NO: 1191 - DNA, 200 bp, Euphorbia heterophylla
acagtgcctcagcagcagttgtagaaagaggattcaggatattgctggcaatatgggatggaattgtaagtacgacactcttgctctgcacagtaactgatccttcaggtgtttcatatgttaaactgtactcccgattgtccaatttagagatacccagaagcttccaagataacttgatattactacccaaacttgat

SEQ ID NO: 1192 - DNA, 200 bp, Euphorbia heterophylla
tctacaactgctgctgaggcactgtcaaaattttattacccaccagtagctgctgtgtctatttcatacccgaaagatgcaattcggacagaacgtttaatagatggcgagcttaagggatttggtcagttgcatcctcgtagtcaaggagtggaaactttaggaaccatatacagctcatcacttttccctaaccgagc

SEQ ID NO: 1193 - DNA, 200 bp, Euphorbia heterophylla
gctcggttagggaaaagtgatgagctgtatatggttcctaaagtttccactccttgactacgaggatgcaactgaccaaatcccttaagctcgccatctattaaacgttctgtccgaattgcatctttcgggtatgaaatagacacagcagctactggtgggtaataaaattttgacagtgcctcagcagcagttgtaga

SEQ ID NO: 1194 - DNA, 200 bp, Euphorbia heterophylla
gctcatcacttttccctaaccgagcaccagatggaagaattttgctcttgaattacattgggggtgctaccaatcctggaatattggccaagaaagacagcgaacttgttgaagcagttgaccgtgatctgcgaaagatgctcataaatcccaatgcaaaggatccacttacacttggcgtaagagtgtggcctcaagcc

SEQ ID NO: 1195 - DNA, 200 bp, Euphorbia heterophylla
ggcttgaggccacactcttacgccaagtgtaagtggatcctttgcattgggatttatgagcatctttcgcagatcacggtcaactgcttcaacaagttcgctgtctttcttggccaatattccaggattggtagcacccccaatgtaattcaagagcaaaattcttccatctggtgctcggttagggaaaagtgatgagc

SEQ ID NO: 1196 - DNA, 200 bp, Euphorbia heterophylla
tggcgtaagagtgtggcctcaagccattccacagtttctgattggtcactacgatatcctagatacggcgaaaaatgcgttaagtgaacaaggcttggaagggctgtttttagggggtaactatgtgtatggtgtagctttgggaaaatgtgttgaaggagcatatgaaactgcgtccagtgttactaatttcctaaccc

SEQ ID NO: 1197 - DNA, 200 bp, Euphorbia heterophylla
gggttaggaaattagtaacactggacgcagtttcatatgctccttcaacacattttcccaaagctacaccatacacatagttaccccctaaaaacagcccttccaagccttgttcacttaacgcatttttcgccgtatctaggatatcgtagtgaccaatcagaaactgtggaatggcttgaggccacactcttacgcca

SEQ ID NO: 1198 - DNA, 200 bp, Euphorbia heterophylla
tccagtgttactaatttcctaacccagtatacttataaatagtatctgatgagatttaagcaagagttcaattatgctgcggctaagtactgtgagtttattgagtagtgggtaaaaatgttgctttaggtctgttgtatttgtaatagttgcttcacgtttttcattaaggatggtgtattctctagttatgcattctt

SEQ ID NO: 1199 - DNA, 200 bp, Euphorbia heterophylla
aagaatgcataactagagaatacaccatccttaatgaaaaacgtgaagcaactattacaaatacaacagacctaaagcaacatttttacccactactcaataaactcacagtacttagccgcagcataattgaactcttgcttaaatctcatcagatactatttataagtatactgggttaggaaattagtaacactgga

SEQ ID NO: 1200 - DNA, 200 bp, Euphorbia heterophylla
tacactaataaatttttaaatttaaatacaataaattgtataatcatatataaatttatcaatttatttctttaaaatctataaaaaaaagttaataaaatactatctacagcccttggaaatgattccataaacctaatccgagtacggagttctaaaatacggattgaaccagacttggaataatacttttgtcgaaa

SEQ ID NO: 1201 - DNA, 200 bp, Euphorbia heterophylla
tttcgacaaaagtattattccaagtctggttcaatccgtattttagaactccgtactcggattaggtttatggaatcatttccaagggctgtagatagtattttattaacttttttttatagattttaaagaaataaattgataaatttatatatgattatacaatttattgtatttaaatttaaaaatttattagtgta

SEQ ID NO: 1202 - DNA, 200 bp, Euphorbia heterophylla
acttggaataatacttttgtcgaaagcccagaaagtctgggtccgctcgattaacatgtcaaaacaatagaagaaaatatctttttattttcgtgtaaatgaatttaccagtaaggttgcgtttatcatttgtagccttcgtccaatcagattgacacgctatatttctccttgtcaattgaagataacacagcactatt

SEQ ID NO: 1203 - DNA, 200 bp, Euphorbia heterophylla
aatagtgctgtgttatcttcaattgacaaggagaaatatagcgtgtcaatctgattggacgaaggctacaaatgataaacgcaaccttactggtaaattcatttacacgaaaataaaaagatattttcttctattgttttgacatgttaatcgagcggacccagactttctgggctttcgacaaaagtattattccaagt

SEQ ID NO: 1204 - DNA, 200 bp, Euphorbia heterophylla
caattgaagataacacagcactatttccctattagttctgaggccgccactaaacggcggtgcgcttgcctcttaccaccacctttcgccgccatggcctctatttccgacttgtctcttttccggccaacaccttctcttgttccatcattttccaaacgcaatttaaacaactctatccacaaacaattcaaactccg

SEQ ID NO: 1205 - DNA, 200 bp, Euphorbia heterophylla
cggagtttgaattgtttgtggatagagttgtttaaattgcgtttggaaaatgatggaacaagagaaggtgttggccggaaaagagacaagtcggaaatagaggccatggcggcgaaaggtggtggtaagaggcaagcgcaccgccgtttagtggcggcctcagaactaatagggaaatagtgctgtgttatcttcaattg

SEQ ID NO: 1206 - DNA, 200 bp, Euphorbia heterophylla
ctatccacaaacaattcaaactccgatgctcaattacagagcagccttccacaatttccccatccaatcccggagacaaatccttatccggcaacggacattccgcctcagtagattgcgtgattgtaggaggtggaatcactggtctctgcattgctcaggcactcgccactaagcaccggaatgttgctcccaatgtt

SEQ ID NO: 1207 - DNA, 200 bp, Euphorbia heterophylla
aacattgggagcaacattccggtgcttagtggcgagtgcctgagcaatgcagagaccagtgattccacctcctacaatcacgcaatctactgaggcggaatgtccgttgccggataaggatttgtctccgggattggatggggaaattgtggaaggctgctctgtaattgagcatcggagtttgaattgtttgtggatag

SEQ ID NO: 1208 - DNA, 200 bp, Euphorbia heterophylla
gcaccggaatgttgctcccaatgttattgtcaccgaggctagagatcgcgtcggtggcaacatcaacaccgttgaaagggacggctatctctgggaagaggggcctaacagtttccagccctccgatcctatgctaaccatggcggtgaggatccaatttctaattgattgtcatgtctaacaaattattgacgaaattt

SEQ ID NO: 1209 - DNA, 200 bp, Euphorbia heterophylla
aaatttcgtcaataatttgttagacatgacaatcaattagaaattggatcctcaccgccatggttagcataggatcggagggctggaaactgttaggcccctcttcccagagatagccgtccctttcaacggtgttgatgttgccaccgacgcgatctctagcctcggtgacaataacattgggagcaacattccggtgc

SEQ ID NO: 1210 - DNA, 200 bp, Euphorbia heterophylla
gtctaacaaattattgacgaaatttgcttgtaattggagattttggttgaattagctaatttgatcgtattgtaggtggatagtggtttgaaggatgacctagttttgggggatcctactgcgccacggtttgtattgtgggatggacaattgaggccagttccttctaagccaagtgacttgccgttctttgatttgat

SEQ ID NO: 1211 - DNA, 200 bp, Euphorbia heterophylla
atcaaatcaaagaacggcaagtcacttggcttagaaggaactggcctcaattgtccatcccacaatacaaaccgtggcgcagtaggatcccccaaaactaggtcatccttcaaaccactatccacctacaatacgatcaaattagctaattcaaccaaaatctccaattacaagcaaatttcgtcaataatttgttagac

SEQ ID NO: 1212 - DNA, 200 bp, Euphorbia heterophylla
gtgacttgccgttctttgatttgatgagcattggtggaaaactcagagctggttttggtgctcttggacttcggcctccacctccagtttgtcctctttaactttcttattgtaattgttctccgattgaaaatagttccccgtgtgtaattttatctgctcgaaaccttacaattctgctgaaagtgacagggacgtga

SEQ ID NO: 1213 - DNA, 200 bp, Euphorbia heterophylla
tcacgtccctgtcactttcagcagaattgtaaggtttcgagcagataaaattacacacggggaactattttcaatcggagaacaattacaataagaaagttaaagaggacaaactggaggtggaggccgaagtccaagagcaccaaaaccagctctgagttttccaccaatgctcatcaaatcaaagaacggcaagtcac

SEQ ID NO: 1214 - DNA, 200 bp, Euphorbia heterophylla
tctgctgaaagtgacagggacgtgaggaatcagttgaagagtttgtgcgccgcaaccttggagatgaagttttcgagcgtttgattgagccattttgttcaggtaagttaagatatttgtagcttgtagtgttcttattagttgacactgtatcatgtcaagttgtgttatcagacccaatacaacatcttactaatcat

SEQ ID NO: 1215 - DNA, 200 bp, Euphorbia heterophylla
atgattagtaagatgttgtattgggtctgataacacaacttgacatgatacagtgtcaactaataagaacactacaagctacaaatatcttaacttacctgaacaaaatggctcaatcaaacgctcgaaaacttcatctccaaggttgcggcgcacaaactcttcaactgattcctcacgtccctgtcactttcagcaga

SEQ ID NO: 1216 - DNA, 200 bp, Euphorbia heterophylla
cccaatacaacatcttactaatcatcacatgaatattgctgtatttcccatgtaaaattaaaccgatacaacatacctcgacttaaattgatgaatacaattcaatgtagtggtacttagttgacgtccctcttggttcgacgacctcttttaattatgatatgttgtgtttatctaaacactaatttatgaatttcatt

SEQ ID NO: 1217 - DNA, 200 bp, Euphorbia heterophylla
aatgaaattcataaattagtgtttagataaacacaacatatcataattaaaagaggtcgtcgaaccaagagggacgtcaactaagtaccactacattgaattgtattcatcaatttaagtcgaggtatgttgtatcggtttaattttacatgggaaatacagcaatattcatgtgatgattagtaagatgttgtattggg

SEQ ID NO: 1218 - DNA, 200 bp, Euphorbia heterophylla
taaacactaatttatgaatttcattcaaaatctatgccattgttaatacaaatcattatcaaacttgaaatgaattccattattgaagtttatattgcatgctcaatctgatatttgattcatttatttaagtagtcctttagcgtgcatatcgtgaatggttccttgagatgtgcttttgatcatgtagcatccatcat

SEQ ID NO: 1219 - DNA, 200 bp, Euphorbia heterophylla
atgatggatgctacatgatcaaaagcacatctcaaggaaccattcacgatatgcacgctaaaggactacttaaataaatgaatcaaatatcagattgagcatgcaatataaacttcaataatggaattcatttcaagtttgataatgatttgtattaacaatggcatagattttgaatgaaattcataaattagtgttta

SEQ ID NO: 1220 - DNA, 200 bp, Euphorbia heterophylla
cttttgatcatgtagcatccatcatggtgatggcttatttgttctagctatatataagatgataagagaatgactaaatgggtaacttgtctatgctgtccagaggtgtttaattgctttgcagtatctgaaaaagagtcagttggtttccctatgatgtatgcttctcaaacttaaaatcgccctagttgattttgttg

SEQ ID NO: 1221 - DNA, 200 bp, Euphorbia heterophylla
caacaaaatcaactagggcgattttaagtttgagaagcatacatcatagggaaaccaactgactctttttcagatactgcaaagcaattaaacacctctggacagcatagacaagttacccatttagtcattctcttatcatcttatatatagctagaacaaataagccatcaccatgatggatgctacatgatcaaaag

SEQ ID NO: 1222 - DNA, 200 bp, Euphorbia heterophylla
aaaatcgccctagttgattttgttgctaaagtcggaagttttatttgtataatttgtatatcttgacaaggttgtccttaatgggagatgctatttttcatgtgcaggtgtttatgcaggtgatcctgcaaaactcagcatgaaagcagcattcggaaaagtttggatgctggaacaaaatggaggcagtatcattggtg

SEQ ID NO: 1223 - DNA, 200 bp, Euphorbia heterophylla
caccaatgatactgcctccattttgttccagcatccaaacttttccgaatgctgctttcatgctgagttttgcaggatcacctgcataaacacctgcacatgaaaaatagcatctcccattaaggacaaccttgtcaagatatacaaattatacaaataaaacttccgactttagcaacaaaatcaactagggcgatttt

SEQ ID NO: 1224 - DNA, 200 bp, Euphorbia heterophylla
caaaatggaggcagtatcattggtggcacttttaaagcaatccaggaaaggaataaaaatcccaagcctcctcgagacccgtatatttatctccttgctttgagaatatcttacatcttttgtttttgtttagtttcttgactctagtgccctgcaggcgtctaccaaaaccaaagggccaaacagtagggtcttttagg

SEQ ID NO: 1225 - DNA, 200 bp, Euphorbia heterophylla
cctaaaagaccctactgtttggccctttggttttggtagacgcctgcagggcactagagtcaagaaactaaacaaaaacaaaagatgtaagatattctcaaagcaaggagataaatatacgggtctcgaggaggcttgggatttttattcctttcctggattgctttaaaagtgccaccaatgatactgcctccattttg

SEQ ID NO: 1226 - DNA, 200 bp, Euphorbia heterophylla
gggccaaacagtagggtcttttaggaagggactgactatgcttccagaggcaattgcatcaaggtaacatttccaccggaattgaattttatgaactttagatggttgtaataattcttgacagtggctgaagtaattgactgattacctgcattggtgttgcagtttgggtagtaatatcaagttatcttggaagcttc

SEQ ID NO: 1227 - DNA, 200 bp, Euphorbia heterophylla
gaagcttccaagataacttgatattactacccaaactgcaacaccaatgcaggtaatcagtcaattacttcagccactgtcaagaattattacaaccatctaaagttcataaaattcaattccggtggaaatgttaccttgatgcaattgcctctggaagcatagtcagtcccttcctaaaagaccctactgtttggccc

SEQ ID NO: 1228 - DNA, 200 bp, Euphorbia heterophylla
tttattgtgtaataattaaaggataatattactgtaaaataatttatattatttaatataataattttaatattattatttttccttaaaagaattataaatgagcttgtaatgttcatgaacaatccatgaataagccaattgttaaatagaccattcatgaatatgcattttgagctcgaattaaactcagcttattt

SEQ ID NO: 1229 - DNA, 200 bp, Euphorbia heterophylla
aaataagctgagtttaattcgagctcaaaatgcatattcatgaatggtctatttaacaattggcttattcatggattgttcatgaacattacaagctcatttataattcttttaaggaaaaataataatattaaaattattatattaaataatataaattattttacagtaatattatcctttaattattacacaataaa

SEQ ID NO: 1230 - DNA, 200 bp, Euphorbia heterophylla
agctcgaattaaactcagcttatttacattgttgtacatgtgaaatcaagagaatgctcataaagtgagtattaaaccgaaacattttatatttcttaaaggtctgacacatgaattctgagaaatcaaatctgtaatattttgacaaatgaaataaatcgtaaaatacatatattcattttagtaaaatctctaaattt

SEQ ID NO: 1231 - DNA, 200 bp, Euphorbia heterophylla
aaatttagagattttactaaaatgaatatatgtattttacgatttatttcatttgtcaaaatattacagatttgatttctcagaattcatgtgtcagacctttaagaaatataaaatgtttcggtttaatactcactttatgagcattctcttgatttcacatgtacaacaatgtaaataagctgagtttaattcgagct

SEQ ID NO: 1232 - DNA, 200 bp, Euphorbia heterophylla
tcattttagtaaaatctctaaatttttaattctttcaatcttaacatcttcttcctcaaatccttgtaacaaatcacagcacaatattttagcattcaaattcatagaatataattaaccgttcaaatctaccaatcccacctccttacccacagcttctactccgagtccattcattaaccctcctctctttgttacaa

SEQ ID NO: 1233 - DNA, 200 bp, Euphorbia heterophylla
ttgtaacaaagagaggagggttaatgaatggactcggagtagaagctgtgggtaaggaggtgggattggtagatttgaacggttaattatattctatgaatttgaatgctaaaatattgtgctgtgatttgttacaaggatttgaggaagaagatgttaagattgaaagaattaaaaatttagagattttactaaaatga

SEQ ID NO: 1234 - DNA, 200 bp, Euphorbia heterophylla
attaaccctcctctctttgttacaaattcttccatgtcttatttttactaaaatctatgctatctatgtttcctaaaattattccacctgctttcagttttaataaaacttcagatactttgaagaactccaacactccattaaatgagaccaagtttcgcaagtcgggctaccctttgttgggcccaagcgcaatttgg

SEQ ID NO: 1235 - DNA, 200 bp, Euphorbia heterophylla
ccaaattgcgcttgggcccaacaaagggtagcccgacttgcgaaacttggtctcatttaatggagtgttggagttcttcaaagtatctgaagttttattaaaactgaaagcaggtggaataattttaggaaacatagatagcatagattttagtaaaaataagacatggaagaatttgtaacaaagagaggagggttaat

SEQ ID NO: 1236 - DNA, 200 bp, Euphorbia heterophylla
tttgttgggcccaagcgcaatttggacacctattttttactaagttcggcttaagcctcagcccgtcaaaatttaaagttttatgcgttgagctgggttttttacaattatccgagcctaatccgataaataataatttaattttttttatatattatatattgtactaaataattatttcaatatttatatttcaaagt

SEQ ID NO: 1237 - DNA, 200 bp, Euphorbia heterophylla
actttgaaatataaatattgaaataattatttagtacaatatataatatataaaaaaaattaaattattatttatcggattaggctcggataattgtaaaaaacccagctcaacgcataaaactttaaattttgacgggctgaggcttaagccgaacttagtaaaaaataggtgtccaaattgcgcttgggcccaacaaa

SEQ ID NO: 1238 - DNA, 200 bp, Euphorbia heterophylla
tatttcaatatttatatttcaaagttatgggtgtgcatctggttaaaacctaatagaatcgaataaatcgaatatcaaatagagaaaccaaaccaaatacgaatcaaaatcgaattaaccaaatcaaaaataaattattccgtttggttaaaaaccgaaccaaaccaaatttttttaaaaaacaaacttaaattaaaaat

SEQ ID NO: 1239 - DNA, 200 bp, Euphorbia heterophylla
atttttaatttaagtttgttttttaaaaaaatttggtttggttcggtttttaaccaaacggaataatttatttttgatttggttaattcgattttgattcgtatttggtttggtttctctatttgatattcgatttattcgattctattaggttttaaccagatgcacacccataactttgaaatataaatattgaaata

SEQ ID NO: 1240 - DNA, 200 bp, Euphorbia heterophylla
taaaaaacaaacttaaattaaaaattttaactcttaaaatccaaaaataagtattacaatagttcaaatgacttagttttgacacataaatgaatgagggtgcattttggggtttgatgttaaaatgatctatatttgagcattattagtagaatattttaaatttttattatgatatttcaattcgattcggttattgt

SEQ ID NO: 1241 - DNA, 200 bp, Euphorbia heterophylla
acaataaccgaatcgaattgaaatatcataataaaaatttaaaatattctactaataatgctcaaatatagatcattttaacatcaaaccccaaaatgcaccctcattcatttatgtgtcaaaactaagtcatttgaactattgtaatacttatttttggattttaagagttaaaatttttaatttaagtttgtttttta

SEQ ID NO: 1242 - DNA, 200 bp, Euphorbia heterophylla
tatttcaattcgattcggttattgtagttttttcaacactaaaactgaactgaaaattgaaatgtttaactttaataaataaaccgaaccgaattttcaaagtaaccgaaccaaattaataactcagtcttattcgattcggaaatgtagttaccaaaaccatttgcacacccatattttacactaatgaatttttaaac

SEQ ID NO: 1243 - DNA, 200 bp, Euphorbia heterophylla
gtttaaaaattcattagtgtaaaatatgggtgtgcaaatggttttggtaactacatttccgaatcgaataagactgagttattaatttggttcggttactttgaaaattcggttcggtttatttattaaagttaaacatttcaattttcagttcagttttagtgttgaaaaaactacaataaccgaatcgaattgaaata

SEQ ID NO: 1244 - DNA, 200 bp, Euphorbia heterophylla
attttacactaatgaatttttaaacttaaatacaataaattgtataaattattaaaaatttcaaataaataatataatcatacgtaattttgtcaatttatttcttaaaatctataaaaaaaaaagttattaaaatactatctacagcctttggaaatgattccataagcctgatccgagcacggagttctaaaatacgg

SEQ ID NO: 1245 - DNA, 200 bp, Euphorbia heterophylla
ccgtattttagaactccgtgctcggatcaggcttatggaatcatttccaaaggctgtagatagtattttaataacttttttttttatagattttaagaaataaattgacaaaattacgtatgattatattatttatttgaaatttttaataatttatacaatttattgtatttaagtttaaaaattcattagtgtaaaat

SEQ ID NO: 1246 - DNA, 200 bp, Euphorbia heterophylla
ccgagcacggagttctaaaatacggattgaagcagacttggaatgatacttttgtcgaaagcccacaaagtctggcctgttcgattaacatgtcaaaacaatagaagaaaatatctttttattttcgtgtaaatgaatttaccagtaaggttgcgtttatcatttgtagccttcgtccaatcagattgacacgctatatt

SEQ ID NO: 1247 - DNA, 200 bp, Euphorbia heterophylla
aatatagcgtgtcaatctgattggacgaaggctacaaatgataaacgcaaccttactggtaaattcatttacacgaaaataaaaagatattttcttctattgttttgacatgttaatcgaacaggccagactttgtgggctttcgacaaaagtatcattccaagtctgcttcaatccgtattttagaactccgtgctcgg

SEQ ID NO: 1248 - DNA, 200 bp, Euphorbia heterophylla
tccaatcagattgacacgctatatttctccttgtcaattgaagataacacagcactatttccctattagttctgaggccgccactaaacggagtgcgcttgcctcttaccaccacctttcgccgccatggcctctatttccgacttgtctcttttccggccaacaccttctcttgttccatcattttccaaacgcaattt

SEQ ID NO: 1249 - DNA, 200 bp, Euphorbia heterophylla
aaattgcgtttggaaaatgatggaacaagagaaggtgttggccggaaaagagacaagtcggaaatagaggccatggcggcgaaaggtggtggtaagaggcaagcgcactccgtttagtggcggcctcagaactaatagggaaatagtgctgtgttatcttcaattgacaaggagaaatatagcgtgtcaatctgattgga

SEQ ID NO: 1250 - DNA, 200 bp, Euphorbia heterophylla
ttccatcattttccaaacgcaatttaaacaactctatccacaaacaattcaaactccgatgctcaattacagagcagccttccacaatttccccatccaatcccggagacaaatccttatccggcaacggacattccgcctcagtagattgcgtgattgtaggaggtggaatcactggtctctgcattgctcaggcactt

SEQ ID NO: 1251 - DNA, 200 bp, Euphorbia heterophylla
aagtgcctgagcaatgcagagaccagtgattccacctcctacaatcacgcaatctactgaggcggaatgtccgttgccggataaggatttgtctccgggattggatggggaaattgtggaaggctgctctgtaattgagcatcggagtttgaattgtttgtggatagagttgtttaaattgcgtttggaaaatgatggaa

SEQ ID NO: 1252 - DNA, 200 bp, Euphorbia heterophylla
tggtctctgcattgctcaggcacttgccactaagcaccggaatgttgctcccaacgttattgtcaccgaggctagagatcgcgtcggtggcaacatcaacaccgttgaaagggacggctatctctgggaagaggggcctaacagtttccagccctccgatcctatgctaaccatggcggtgaggatccaatttctaattg

SEQ ID NO: 1253 - DNA, 200 bp, Euphorbia heterophylla
caattagaaattggatcctcaccgccatggttagcataggatcggagggctggaaactgttaggcccctcttcccagagatagccgtccctttcaacggtgttgatgttgccaccgacgcgatctctagcctcggtgacaataacgttgggagcaacattccggtgcttagtggcaagtgcctgagcaatgcagagacca

SEQ ID NO: 1254 - DNA, 200 bp, Euphorbia heterophylla
gcggtgaggatccaatttctaattgattgtcatgtctaacaaattattgacgaaatttgcttgtaattggagattttggttgaattagctaatttgatcgtattgtaggtggatagtggtttgaaggatgacctagttttgggggatcctactgcgccacggtttgtattgtgggatgggcaattgaggccagttccttc

SEQ ID NO: 1255 - DNA, 200 bp, Euphorbia heterophylla
gaaggaactggcctcaattgcccatcccacaatacaaaccgtggcgcagtaggatcccccaaaactaggtcatccttcaaaccactatccacctacaatacgatcaaattagctaattcaaccaaaatctccaattacaagcaaatttcgtcaataatttgttagacatgacaatcaattagaaattggatcctcaccgc

SEQ ID NO: 1256 - DNA, 200 bp, Euphorbia heterophylla
atgggcaattgaggccagttccttctaagccaagtgacttgccgttctttgatttgatgagcattggtggaaaactcagagctggttttggtgctcttggacttcggcctccacctccagtttgtcctctttaactttcttattgtaattgttctccgattgaaaatagtcccccgtgtgtaattttatctgctcgtaac

SEQ ID NO: 1257 - DNA, 200 bp, Euphorbia heterophylla
gttacgagcagataaaattacacacgggggactattttcaatcggagaacaattacaataagaaagttaaagaggacaaactggaggtggaggccgaagtccaagagcaccaaaaccagctctgagttttccaccaatgctcatcaaatcaaagaacggcaagtcacttggcttagaaggaactggcctcaattgcccat

SEQ ID NO: 1258 - DNA, 200 bp, Euphorbia heterophylla
gtgtgtaattttatctgctcgtaaccttacaattctgctgaaagtgacagggacgtgaggaatcagttgaagagtttgtgcgccgcaaccttggagatgaagttttcgagcgtttgattgagccattttgttcaggtaagttaagatatttggagcttgtagtgttcttattagttgacactgtatcatgtcaagttgtg

SEQ ID NO: 1259 - DNA, 200 bp, Euphorbia heterophylla
cacaacttgacatgatacagtgtcaactaataagaacactacaagctccaaatatcttaacttacctgaacaaaatggctcaatcaaacgctcgaaaacttcatctccaaggttgcggcgcacaaactcttcaactgattcctcacgtccctgtcactttcagcagaattgtaaggttacgagcagataaaattacacac

SEQ ID NO: 1260 - DNA, 200 bp, Euphorbia heterophylla
tgacactgtatcatgtcaagttgtgttatcagacccattacaacatcttaccaatcatcacatgaatattgctgtatttcccatgtaaaattaaaccgatacaacatacctcgacttaaattgacgaatacaattcaatgtagtggtacttagttgacgtcccttttggttcgacgacctcttttaattatgatatgttg

SEQ ID NO: 1261 - DNA, 200 bp, Euphorbia heterophylla
caacatatcataattaaaagaggtcgtcgaaccaaaagggacgtcaactaagtaccactacattgaattgtattcgtcaatttaagtcgaggtatgttgtatcggtttaattttacatgggaaatacagcaatattcatgtgatgattggtaagatgttgtaatgggtctgataacacaacttgacatgatacagtgtca

SEQ ID NO: 1262 - DNA, 200 bp, Euphorbia heterophylla
gacctcttttaattatgatatgttgtgttatatctaaacactaaattatgaatttcattcaaaatctatgccattgttaatacaaatcattatcaaacttgaagtgaattccattattgaagtttatattgcatgctcaatctcatccatctgatatttgattcatttatttaagtagtcctttagcgtgcatatcgtga

SEQ ID NO: 1263 - DNA, 200 bp, Euphorbia heterophylla
tcacgatatgcacgctaaaggactacttaaataaatgaatcaaatatcagatggatgagattgagcatgcaatataaacttcaataatggaattcacttcaagtttgataatgatttgtattaacaatggcatagattttgaatgaaattcataatttagtgtttagatataacacaacatatcataattaaaagaggtc

SEQ ID NO: 1264 - DNA, 200 bp, Euphorbia heterophylla
tagtcctttagcgtgcatatcgtgaatggttccttgagatgtgcttttgatcatgtagcatccatcatggtgatggcttatttgttctagctatatataagatgataagagaatgactaaatgggtaacttgtctatgctgtccagaggtgtttaattgctttgcagtatctgaaaaagagtcagttggtttccctatga

SEQ ID NO: 1265 - DNA, 200 bp, Euphorbia heterophylla
tcatagggaaaccaactgactctttttcagatactgcaaagcaattaaacacctctggacagcatagacaagttacccatttagtcattctcttatcatcttatatatagctagaacaaataagccatcaccatgatggatgctacatgatcaaaagcacatctcaaggaaccattcacgatatgcacgctaaaggacta

SEQ ID NO: 1266 - DNA, 200 bp, Euphorbia heterophylla
aaagagtcagttggtttccctatgatgtatgcttctcaaacttaaaatcgccctagttgattttgttgctaaattcggaagttttatttgtataatttgtatatcttgacaaggttgtccttaatgggagatgctatttttcatgtgcaggtgtttatgcaggtgatcctgcaaaactcagcatgaaagcagcattcgga

SEQ ID NO: 1267 - DNA, 200 bp, Euphorbia heterophylla
tccgaatgctgctttcatgctgagttttgcaggatcacctgcataaacacctgcacatgaaaaatagcatctcccattaaggacaaccttgtcaagatatacaaattatacaaataaaacttccgaatttagcaacaaaatcaactagggcgattttaagtttgagaagcatacatcatagggaaaccaactgactcttt

SEQ ID NO: 1268 - DNA, 200 bp, Euphorbia heterophylla
actcagcatgaaagcagcattcggaaaagtttggatgctggaacaaaatggaggcagtatcattggtggcacttttaaagcaatccaggaaaggaataaaaatcccaagcctcctcgagacccgtatatttatctccttgctttgagaatatcttacatcttttgtttttgttgagtttcttgactctagtgccctgcag

SEQ ID NO: 1269 - DNA, 200 bp, Euphorbia heterophylla
ctgcagggcactagagtcaagaaactcaacaaaaacaaaagatgtaagatattctcaaagcaaggagataaatatacgggtctcgaggaggcttgggatttttattcctttcctggattgctttaaaagtgccaccaatgatactgcctccattttgttccagcatccaaacttttccgaatgctgctttcatgctgagt

SEQ ID NO: 1270 - DNA, 200 bp, Euphorbia heterophylla
gtttcttgactctagtgccctgcaggcgtctaccaaaaccaaagggccaaacagtagggtcttttaggaagggactgactatgcttccagaggcaattgcatcaaggtaacatttccaccggaattaaaattttatgaactttagatggttgtaataattcttgacagtggctgaagtaattgactgattacctgcattg

SEQ ID NO: 1271 - DNA, 200 bp, Euphorbia heterophylla
caatgcaggtaatcagtcaattacttcagccactgtcaagaattattacaaccatctaaagttcataaaattttaattccggtggaaatgttaccttgatgcaattgcctctggaagcatagtcagtcccttcctaaaagaccctactgtttggccctttggttttggtagacgcctgcagggcactagagtcaagaaac

SEQ ID NO: 1272 - DNA, 200 bp, Euphorbia heterophylla
agtaattgactgattacctgcattggtgttgcagtttgggtagtaatatcaagttatcttggaagcttctgggtatctctaaattggacaatcgggagtacagtttaacatatgaaacacctgaaggatcagttactgtgcagagcaagagtgtcgtacttacaattccatcccatattgccagcaatatcctgaatcct

SEQ ID NO: 1273 - DNA, 200 bp, Euphorbia heterophylla
aggattcaggatattgctggcaatatgggatggaattgtaagtacgacactcttgctctgcacagtaactgatccttcaggtgtttcatatgttaaactgtactcccgattgtccaatttagagatacccagaagcttccaagataacttgatattactacccaaactgcaacaccaatgcaggtaatcagtcaattact

SEQ ID NO: 1274 - DNA, 77 bp, Euphorbia heterophylla; identical to SEQ ID NO: 48

SEQ ID NO: 1275 - DNA, 77 bp, Euphorbia heterophylla
tactctgaaaattcggttcggtttgtttattaaagttaaacatttcaattttcaattcagttttagtgttgaaaaaa

SEQ ID NO: 1276 - DNA, 200 bp, Kochia scoparia
atacactgctctacaatctcaacctcaactccaacctcaagttcaaacccaggaacacttggcgaaggaggattattggattgtgtgatcgtgggaggtggtattagtgggctctgcattgcacaagcactttctacaaagtactcttctctttctacaaatttcattgttaccgaggcgaaagatcgagttggtggcaa

SEQ ID NO: 1277 - DNA, 200 bp, Kochia scoparia
ttgccaccaactcgatctttcgcctcggtaacaatgaaatttgtagaaagagaagagtactttgtagaaagtgcttgtgcaatgcagagcccactaataccacctcccacgatcacacaatccaataatcctccttcgccaagtgttcctgggtttgaacttgaggttggagttgaggttgagattgtagagcagtgtat

SEQ ID NO: 1278 - DNA, 200 bp, Kochia scoparia
aggcgaaagatcgagttggtggcaacattaccaccaaggaggatgatggctatatctgggaagaaggacccaacagttttcagccgtctgatgcagttctcaccatggctgttgattgtgggttgaaagatgaattggtgtttggtgaccccaaagcacctcgatttgtgctgtggaatgggaaattaaggcgggtacct

SEQ ID NO: 1279 - DNA, 200 bp, Kochia scoparia
aggtacccgccttaatttcccattccacagcacaaatcgaggtgctttggggtcaccaaacaccaattcatctttcaacccacaatcaacagccatggtgagaactgcatcagacggctgaaaactgttgggtccttcttcccagatatagccatcatcctccttggtggtaatgttgccaccaactcgatctttcgcct

SEQ ID NO: 1280 - DNA, 200 bp, Kochia scoparia
gaatgggaaattaaggcgggtaccttctaagctcacagatctccctttctttgatcttatgagctttcctggcaagattagagctggccttggcgctcttggatttcgtccttctccaccaggtcgtgaagaatctgttgaggattttgttcgtcgaaatcttggcgatgaggtctttgaacgtttgattgaaccttttt

SEQ ID NO: 1281 - DNA, 200 bp, Kochia scoparia
aaaaaggttcaatcaaacgttcaaagacctcatcgccaagatttcgacgaacaaaatcctcaacagattcttcacgacctggtggagaaggacgaaatccaagagcgccaaggccagctctaatcttgccaggaaagctcataagatcaaagaaagggagatctgtgagcttagaaggtacccgccttaatttcccattc

SEQ ID NO: 1282 - DNA, 200 bp, Kochia scoparia
tttgaacgtttgattgaacctttttgttcaggtgtgtatgctggtgatcctgccaagttaagcatgaaagctgcttttggcagagtgtgggttttggagcagatgggtggtaatatcattggtggcgctctcaaaactatccaggaaaagaagaataagcctaagccgcctcgagatccgcgccttccgaagccaaaggg

SEQ ID NO: 1283 - DNA, 200 bp, Kochia scoparia
ccctttggcttcggaaggcgcggatctcgaggcggcttaggcttattcttcttttcctggatagttttgagagcgccaccaatgatattaccacccatctgctccaaaacccacactctgccaaaagcagctttcatgcttaacttggcaggatcaccagcatacacacctgaacaaaaaggttcaatcaaacgttcaaa

SEQ ID NO: 1284 - DNA, 200 bp, Kochia scoparia
atccgcgccttccgaagccaaagggtcagacagttggatcctttaggaaaggactcattatgttgccgaacgccatttctgctaggcttggaagtaaagtgaaactttcttggactctagctagtatttctaagacacacaatggggaatataatttgatttatgatacaccagatggaccggtttccgtaaggactaaa

SEQ ID NO: 1285 - DNA, 200 bp, Kochia scoparia
tttagtccttacggaaaccggtccatctggtgtatcataaatcaaattatattccccattgtgtgtcttagaaatactagctagagtccaagaaagtttcactttacttccaagcctagcagaaatggcgttcggcaacataatgagtcctttcctaaaggatccaactgtctgaccctttggcttcggaaggcgcggat

SEQ ID NO: 1286 - DNA, 200 bp, Kochia scoparia
tggaccggtttccgtaaggactaaaagtatcgtgatgactattccatcatatgttgcaagtagtctgcttcgtccattctcagatgctgctgcagattccctttcaaaatttcactatccacctgttgcagcagtgtcactgtcttatcctgaagaagcgattagacctgagtgcttgattgatggtaaacttcaaggat

SEQ ID NO: 1287 - DNA, 200 bp, Kochia scoparia
atccttgaagtttaccatcaatcaagcactcaggtctaatcgcttcttcaggataagacagtgacactgctgcaacaggtggatagtgaaattttgaaagggaatctgcagcagcatctgagaatggacgaagcagactacttgcaacatatgatggaatagtcatcacgatacttttagtccttacggaaaccggtcca

SEQ ID NO: 1288 - DNA, 200 bp, Kochia scoparia
ttgattgatggtaaacttcaaggattcgggcaactgcatccccgcagtcagggtgtggaaaccttgggatcaatttatagttcatctcttttccctggtcgagcaccacctggtaggaccatgatcttgagcttcattggaggtgctactaatcctggcatagtagacaagacgcaagatgaacttgctaagactgttga

SEQ ID NO: 1289 - DNA, 200 bp, Kochia scoparia
tcaacagtcttagcaagttcatcttgcgtcttgtctactatgccaggattagtagcacctccaatgaagctcaagatcatggtcctaccaggtggtgctcgaccagggaaaagagatgaactataaattgatcccaaggtttccacaccctgactgcggggatgcagttgcccgaatccttgaagtttaccatcaatcaa

SEQ ID NO: 1290 - DNA, 200 bp, Kochia scoparia
aagatgaacttgctaagactgttgacaaggacctgagaagaattcttataaatccaagtgcaaaagatcctcgtgttctaggcgtgaaagtatggcctcaagcaataccccaatttttgataggccactttgatctgcttgatgctgcaaaagctgctttgactgatgctgggtgtaaaggattgtttcttggaggaaac

SEQ ID NO: 1291 - DNA, 200 bp, Kochia scoparia
gtttcctccaagaaacaatcctttacacccagcatcagtcaaagcagcttttgcagcatcaagcagatcaaagtggcctatcaaaaattggggtattgcttgaggccatactttcacgcctagaacacgaggatcttttgcacttggatttataagaattcttctcaggtccttgtcaacagtcttagcaagttcatctt

SEQ ID NO: 1292 - DNA, 200 bp, Kochia scoparia; identical to SEQ ID NO: 1276

SEQ ID NO: 1293 - DNA, 200 bp, Kochia scoparia; identical to SEQ ID NO: 1277

SEQ ID NO: 1294 - DNA, 200 bp, Kochia scoparia; identical to SEQ ID NO: 1278

SEQ ID NO: 1295 - DNA, 200 bp, Kochia scoparia; identical to SEQ ID NO: 1279

SEQ ID NO: 1296 - DNA, 200 bp, Kochia scoparia; identical to SEQ ID NO: 1280

SEQ ID NO: 1297 - DNA, 200 bp, Kochia scoparia; identical to SEQ ID NO: 1281

SEQ ID NO: 1298 - DNA, 200 bp, Kochia scoparia; identical to SEQ ID NO: 1282

SEQ ID NO: 1299 - DNA, 200 bp, Kochia scoparia; identical to SEQ ID NO: 1283

SEQ ID NO: 1300 - DNA, 200 bp, Kochia scoparia; identical to SEQ ID NO: 1284

SEQ ID NO: 1301 - DNA, 200 bp, Kochia scoparia; identical to SEQ ID NO: 1285

SEQ ID NO: 1302 - DNA, 200 bp, Kochia scoparia
caggatgctgctgcagattccctttcaaaatttcactatccacctgttgcagcagtgtcactgtcttatcctgaagaagcgattagacctgagtgcttgattgatggtaaacttcaaggattcgggcaactgcatccccgcagtcagggtgtggaaaccttgggatcaatttatagttcatctcttttccctggtcgagc

SEQ ID NO: 1303 - DNA, 200 bp, Kochia scoparia
gctcgaccagggaaaagagatgaactataaattgatcccaaggtttccacaccctgactgcggggatgcagttgcccgaatccttgaagtttaccatcaatcaagcactcaggtctaatcgcttcttcaggataagacagtgacactgctgcaacaggtggatagtgaaattttgaaagggaatctgcagcagcatcctg

SEQ ID NO: 1304 - DNA, 200 bp, Kochia scoparia
gttcatctcttttccctggtcgagcaccacctggtaggaccatgatcttgagcttcattggaggtgctactaatcctggcatagtagacaagacgcaagatgaacttgctaagactgttgacaaggacctgagaagaattcttataaatccaagtgcaaaagatcctcgtgttctaggcgtgaaagtatggcctcaagca

SEQ ID NO: 1305 - DNA, 200 bp, Kochia scoparia
tgcttgaggccatactttcacgcctagaacacgaggatcttttgcacttggatttataagaattcttctcaggtccttgtcaacagtcttagcaagttcatcttgcgtcttgtctactatgccaggattagtagcacctccaatgaagctcaagatcatggtcctaccaggtggtgctcgaccagggaaaagagatgaac

SEQ ID NO: 1306 - DNA, 200 bp, Kochia scoparia
aggcgtgaaagtatggcctcaagcaataccccaatttttgataggccactttgatctgcttgatgctgcaaaagctgctttgactgatgctgggtgtaaaggattgtttcttggaggaaactatgtatcaggtgttgccttggggcggtgtatagagggtgcttatgaatctgcagccgaggtagttgatttcctctccc

SEQ ID NO: 1307 - DNA, 200 bp, Kochia scoparia
gggagaggaaatcaactacctcggctgcagattcataagcaccctctatacaccgccccaaggcaacacctgatacatagtttcctccaagaaacaatcctttacacccagcatcagtcaaagcagcttttgcagcatcaagcagatcaaagtggcctatcaaaaattggggtattgcttgaggccatactttcacgcct

SEQ ID NO: 1308 - DNA, 200 bp, Kochia scoparia
gtaacttgcctacccctctcagttataattactacattcaagaaggttaatgtgaaaagacctcttgagggctttggagttcttgtcccctctgttgagcagaaaaatgggttgaagactcttggtacactattttcctccatcatgtttcctgatcgtgctccctctgatgtgtatctctatacaacctttgttggtgg

SEQ ID NO: 1309 - DNA, 200 bp, Kochia scoparia
ccaccaacaaaggttgtatagagatacacatcagagggagcacgatcaggaaacatgatggaggaaaatagtgtaccaagagtcttcaacccatttttctgctcaacagaggggacaagaactccaaagccctcaagaggtcttttcacattaaccttcttgaatgtagtaattataactgagaggggtaggcaagttac

SEQ ID NO: 1310 - DNA, 200 bp, Kochia scoparia
atctctatacaacctttgttggtggaagcaggaatagtgaacttgcaaaagcttcaacggatgagctgaagcaaatagtttcttctgaccttgagaagctattgggcactgagggtgaacctacctctgtgaatcatttctattggagcaaggcattccctctttatgggcgcaactatgactcagtactcaaagcaatc

SEQ ID NO: 1311 - DNA, 200 bp, Kochia scoparia
gattgctttgagtactgagtcatagttgcgcccataaagagggaatgccttgctccaatagaaatgattcacagaggtaggttcaccctcagtgcccaatagcttctcaaggtcagaagaaactatttgcttcagctcatccgttgaagcttttgcaagttcactattcctgcttccaccaacaaaggttgtatagagat

SEQ ID NO: 1312 - DNA, 150 bp, Lolium multiflorum; identical to SEQ ID NO: 65

SEQ ID NO: 1313 - DNA, 150 bp, Lolium multiflorum
tttcagaccatgtttttgctgttccttatagggtaccaacaccccaaatccttccaggggtcttttgacatcttccttcttaaaagctgttaccatgagggataacggcagataatccacctgcataataaataccaataaggcaggatt

SEQ ID NO: 1314 - DNA, 108 bp, Lolium multiflorum; identical to SEQ ID NO: 68

SEQ ID NO: 1315 - DNA, 108 bp, Lolium multiflorum
accgccaaggagcgtgtccgcctcgaagacgacgggccggcagccgcgctccagcaggtgcttgcacgccgccaggccgctcacgccggcgccgatgatggccaccct

SEQ ID NO: 1316 - DNA, 144 bp, Lolium multiflorum; identical to SEQ ID NO: 66

SEQ ID NO: 1317 - DNA, 144 bp, Lolium multiflorum
cttttctaaattccataacgctggaaatgcatgacggatagataatgactcaggatctcctgcacttgttccagctacaaatggatcaataagatagtcgacaacttcctttccaaaatggcgttcaaagaagctcccaacact

SEQ ID NO: 1318 - DNA, 114 bp, Lolium multiflorum; identical to SEQ ID NO: 67

SEQ ID NO: 1319 - DNA, 114 bp, Lolium multiflorum
cgttggagctccagcgagatccctattgtggcttcccccaacgaatgttgtaaataagtgttggtcattaggagctcgatctgggaacatcatagaggagaagagggttcctat

SEQ ID NO: 1320 - DNA, 200 bp, Lolium multiflorum
ctcgacgcgaacgcgggatctctttcgcgtcaggcgtgaaatagggccggatttccatatacaactactaaccgagaaccccgcccactggaatgcgattcccagcccatcgacctatccaattccaattccagtgggccatgaaaaccgcaaaccaaccaaccaatacagccgcagccgcatcccgtcatccactccgc

SEQ ID NO: 1321 - DNA, 200 bp, Lolium multiflorum
gcggagtggatgacgggatgcggctgcggctgtattggttggttggtttgcggttttcatggcccactggaattggaattggataggtcgatgggctgggaatcgcattccagtgggcggggttctcggttagtagttgtatatggaaatccggccctatttcacgcctgacgcgaaagagatcccgcgttcgcgtcgag

SEQ ID NO: 1322 - DNA, 200 bp, Lolium multiflorum
agccgcatcccgtcatccactccgcactgccatctcccccgcccgagcgacggaaatggtcggcgcaaccatggccaccgctaccgtcacggcggcgctaccgctccgcctccgggtccccgcgcgcccccgacgcggacagacgcgctgcgcggtcgcgagcgatgccaccgaggcgccggccgtgcccagcgcacggc

SEQ ID NO: 1323 - DNA, 200 bp, Lolium multiflorum
gccgtgcgctgggcacggccggcgcctcggtggcatcgctcgcgaccgcgcagcgcgtctgtccgcgtcgggggcgcgcggggacccggaggcggagcggtagcgccgccgtgacggtagcggtggccatggttgcgccgaccatttccgtcgctcgggcgggggagatggcagtgcggagtggatgacgggatgcggct

SEQ ID NO: 1324 - DNA, 200 bp, Lolium multiflorum
gcgccggccgtgcccagcgcacggctgtccgcggattgcgtcatcgtgggcggcggcatcagcggcctctgcaccgcacaggcgctggccaccaagtacggcgtcaccgacttgctcgtcacggaggcccgcgctcgcgcaggcggcaacatcaccaccgtcgagcgccccgacgaggggtacctctgggaggagggccc

SEQ ID NO: 1325 - DNA, 200 bp, Lolium multiflorum
gggccctcctcccagaggtacccctcgtcggggcgctcgacggtggtgatgttgccgcctgcgcgagcgcgggcctccgtgacgagcaagtcggtgacgccgtacttggtggccagcgcctgtgcggtgcagaggccgctgatgccgccgcccacgatgacgcaatccgcggacagccgtgcgctgggcacggccggcgc

SEQ ID NO: 1326 - DNA, 200 bp, Lolium multiflorum
aggggtacctctgggaggagggccccaacagcttccagccctccgaccccgtcctcaccatggccgtacgcaccatgctcgctttctccttcttttccggattcttcgggacgtaggcgtacagaatacagatacgatcgctgaatggattggttgcgcaggtagacagcgggctcaaggatgacttggtgttcggggac

SEQ ID NO: 1327 - DNA, 200 bp, Lolium multiflorum
gtccccgaacaccaagtcatccttgagcccgctgtctacctgcgcaaccaatccattcagcgatcgtatctgtattctgtacgcctacgtcccgaagaatccggaaaagaaggagaaagcgagcatggtgcgtacggccatggtgaggacggggtcggagggctggaagctgttggggccctcctcccagaggtacccct

SEQ ID NO: 1328 - DNA, 200 bp, Lolium multiflorum
caaggatgacttggtgttcggggaccccaatgcgccgcgcttcgtgctgtggcaggggaagctgaggccggtgccgtccaagcctggcgacctgcctttcttcgacctcatgagtattcctgggaagctcagggccggccttggcgcgctcggcattcgtccgcctcctccagtttgtgctctgcccgtgctctctattc

SEQ ID NO: 1329 - DNA, 200 bp, Lolium multiflorum
gaatagagagcacgggcagagcacaaactggaggaggcggacgaatgccgagcgcgccaaggccggccctgagcttcccaggaatactcatgaggtcgaagaaaggcaggtcgccaggcttggacggcaccggcctcagcttcccctgccacagcacgaagcgcggcgcattggggtccccgaacaccaagtcatccttg

SEQ ID NO: 1330 - DNA, 200 bp, Lolium multiflorum
tgtgctctgcccgtgctctctattctttagtgaattttgattgtcaaagatggggctgagcgttcccggcgaaggtttcaggggcgtgaggagtcggtggaggagtttgtgcgccgcaacctcggcgcggaggtctttgagcgcctcatcgagcctttctgctcaggtaatgtgcagtagtatatgtctgttctgttctg

SEQ ID NO: 1331 - DNA, 200 bp, Lolium multiflorum
cagaacagaacagacatatactactgcacattacctgagcagaaaggctcgatgaggcgctcaaagacctccgcgccgaggttgcggcgcacaaactcctccaccgactcctcacgcccctgaaaccttcgccgggaacgctcagccccatctttgacaatcaaaattcactaaagaatagagagcacgggcagagcaca

SEQ ID NO: 1332 - DNA, 200 bp, Lolium multiflorum
agtagtatatgtctgttctgttctgctctgcttcttgcattgatcccgataataagaatataacatttcgatatcaacgttaggtgtgtatgcgggtgacccttcaaagctcagtatgcgggctgcatttgggaaggtatggagactggaggagaatggaggcagtattattggtggaaccatcaaggcaattcaggata

SEQ ID NO: 1333 - DNA, 200 bp, Lolium multiflorum
tatcctgaattgccttgatggttccaccaataatactgcctccattctcctccagtctccataccttcccaaatgcagcccgcatactgagctttgaagggtcacccgcatacacacctaacgttgatatcgaaatgttatattcttattatcgggatcaatgcaagaagcagagcagaacagaacagacatatactact

SEQ ID NO: 1334 - DNA, 200 bp, Lolium multiflorum
ggaaccatcaaggcaattcaggatagaggcaagaaccccaaaccaccgagggatccgtaagtggagactctacttttctatttagtcagttaactcactgttccattagactcgtattaatctgtttcaccacttttagccgacttccgacaccaaaggggcagacggtggcatctttcaggaagggtctagccatgctc

SEQ ID NO: 1335 - DNA, 200 bp, Lolium multiflorum
gagcatggctagacccttcctgaaagatgccaccgtctgcccctttggtgtcggaagtcggctaaaagtggtgaaacagattaatacgagtctaatggaacagtgagttaactgactaaatagaaaagtagagtctccacttacggatccctcggtggtttggggttcttgcctctatcctgaattgccttgatggttcc

SEQ ID NO: 1336 - DNA, 200 bp, Lolium multiflorum
tttcaggaagggtctagccatgctcccaaatgctatcgcttctaggtttgttttcatcacttgtgcacatacctaagttatgctatcagtatacgtggtgctgtatattgttcagatagaggggacagatctgttggtagacctactgtttgctgaactcaataccatatgaatatcattgcatcagcacccaaagtacc

SEQ ID NO: 1337 - DNA, 200 bp, Lolium multiflorum
ggtactttgggtgctgatgcaatgatattcatatggtattgagttcagcaaacagtaggtctaccaacagatctgtcccctctatctgaacaatatacagcaccacgtatactgatagcataacttaggtatgtgcacaagtgatgaaaacaaacctagaagcgatagcatttgggagcatggctagacccttcctgaaa

SEQ ID NO: 1338 - DNA, 200 bp, Lolium multiflorum
tcattgcatcagcacccaaagtacctgtggctcgattattatatcagccattctcgcattgttgatactaatgcatctgtgttaatctttttcatcttgcttttttggttgggacctgtactatataggaaattccacgagggatgagttatagagcatgtgtgtgtatgtccatgccccttgtactcggagatgatcat

SEQ ID NO: 1339 - DNA, 200 bp, Lolium multiflorum
atgatcatctccgagtacaaggggcatggacatacacacacatgctctataactcatccctcgtggaatttcctatatagtacaggtcccaaccaaaaaagcaagatgaaaaagattaacacagatgcattagtatcaacaatgcgagaatggctgatataataatcgagccacaggtactttgggtgctgatgcaatga

SEQ ID NO: 1340 - DNA, 200 bp, Lolium multiflorum
gccccttgtactcggagatgatcatgaattatagtaataatttcatgcttggtcttaagacgtaaccctgtcatgttttgcattccttcatttccaggttgggtagtaaagtcaaactctcgtggaagcttacgggcattacaaagtcggacaaccagggatatgtgttagcgtatgaaacaccggaaggagttgtttca

SEQ ID NO: 1341 - DNA, 200 bp, Lolium multiflorum
tgaaacaactccttccggtgtttcatacgctaacacatatccctggttgtccgactttgtaatgcccgtaagcttccacgagagtttgactttactacccaacctggaaatgaaggaatgcaaaacatgacagggttacgtcttaagaccaagcatgaaattattactataattcatgatcatctccgagtacaaggggc

SEQ ID NO: 1342 - DNA, 200 bp, Lolium multiflorum
tgaaacaccggaaggagttgtttcagtgcaggctaaaagtgttatcatgaccattccgtcatatattgctagtgaaatcttgcgcccactttcggtaagttcatgtttgcaaaattaattggtgtactactaatgttagtgttaggttcctgtagttctccatactcctgtgcagtggcggacccaggattttggcaaag

SEQ ID NO: 1343 - DNA, 200 bp, Lolium multiflorum
ctttgccaaaatcctgggtccgccactgcacaggagtatggagaactacaggaacctaacactaacattagtagtacaccaattaattttgcaaacatgaacttaccgaaagtgggcgcaagatttcactagcaatatatgacggaatggtcatgataacacttttagcctgcactgaaacaactccttccggtgtttca

SEQ ID NO: 1344 - DNA, 200 bp, Lolium multiflorum
tggcggacccaggattttggcaaagggtatgccacacaaaaaaattggcctgccttgataacgattttttcttagaatatgaagtagaagtgatgattatgaaatatgattgaaaaaatcaaataaaagtgttcttgcattataatcaaaatattaaattgcttaacacatgcacggtttgcgaggtgtcctatttttta

SEQ ID NO: 1345 - DNA, 200 bp, Lolium multiflorum
taaaaaataggacacctcgcaaaccgtgcatgtgttaagcaatttaatattttgattataatgcaagaacacttttatttgattttttcaatcatatttcataatcatcacttctacttcatattctaagaaaaaatcgttatcaaggcaggccaatttttttgtgtggcataccctttgccaaaatcctgggtccgcca

SEQ ID NO: 1346 - DNA, 200 bp, Lolium multiflorum
ggtttgcgaggtgtcctattttttaaactaatttctcaccgtaccatctgaccctaaatttctgaagtatttgaccacggaataatcgtttcagcaacactacaagataacgttagatcgtactaaataaacaaagaaatatgctgaagaaagctacaacggagcatataaaaattagtcacaatagctaaatggtttct

SEQ ID NO: 1347 - DNA, 200 bp, Lolium multiflorum
agaaaccatttagctattgtgactaatttttatatgctccgttgtagctttcttcagcatatttctttgtttatttagtacgatctaacgttatcttgtagtgttgctgaaacgattattccgtggtcaaatacttcagaaatttagggtcagatggtacggtgagaaattagtttaaaaaataggacacctcgcaaacc

SEQ ID NO: 1348 - DNA, 200 bp, Lolium multiflorum
tagtcacaatagctaaatggtttcttaattaatcaccatagctaatcatccattacgaaagtacctggacgcatgcatggtgcatggccatgtctctaggctagtttagcaattaaccggatggtcaagtgagtaccaaaaactaataaagcatgtgtccctgtacgatgcatgctcgcaggctacatgcaccggcttga

SEQ ID NO: 1349 - DNA, 200 bp, Lolium multiflorum
tcaagccggtgcatgtagcctgcgagcatgcatcgtacagggacacatgctttattagtttttggtactcacttgaccatccggttaattgctaaactagcctagagacatggccatgcaccatgcatgcgtccaggtactttcgtaatggatgattagctatggtgattaattaagaaaccatttagctattgtgacta

SEQ ID NO: 1350 - DNA, 200 bp, Lolium multiflorum
tcgcaggctacatgcaccggcttgattaaaatggccagctgattacaggcggttcatatggctgggccgctaggtatgccatggcatatgcggcataccctgtaggtccgcactgctcctgtggtaaccatgaaatagcacgctagtacactattccttaatagagttgctaatcaataattgaccgcattacgatactg

SEQ ID NO: 1351 - DNA, 200 bp, Lolium multiflorum
cagtatcgtaatgcggtcaattattgattagcaactctattaaggaatagtgtactagcgtgctatttcatggttaccacaggagcagtgcggacctacagggtatgccgcatatgccatggcatacctagcggcccagccatatgaaccgcctgtaatcagctggccattttaatcaagccggtgcatgtagcctgcga

SEQ ID NO: 1352 - DNA, 200 bp, Lolium multiflorum
aataattgaccgcattacgatactggttgcctgtaatcttagtccaaacacatgattgagcatttttgttgagagattaattgattaatgtggttaaactgttcactgatgcataggttggactatttcttcaccaatcaactctatgtttcaaataattgaaatatacatcaatagattcagaaaactgtatcttgttt

SEQ ID NO: 1353 - DNA, 200 bp, Lolium multiflorum
aaacaagatacagttttctgaatctattgatgtatatttcaattatttgaaacatagagttgattggtgaagaaatagtccaacctatgcatcagtgaacagtttaaccacattaatcaattaatctctcaacaaaaatgctcaatcatgtgtttggactaagattacaggcaaccagtatcgtaatgcggtcaattatt

SEQ ID NO: 1354 - DNA, 200 bp, Lolium multiflorum
gagcgcctcatcgagccttctgctcaggtgtgtatgcgggtgacccttcaaagctcagtatgagggctgcgtttgggaaggtatggagactggaggagaatggaggcagtattattggtggaaccatcaaggcaattcaggatagaggcaagaaccccaaaccgccgagggatccccgacttccgacaccaaaggggcag

SEQ ID NO: 1355 - DNA, 200 bp, Lolium multiflorum
ctgcccctttggtgtcggaagtcggggatccctcggcggtttggggttcttgcctctatcctgaattgccttgatggttccaccaataatactgcctccattctcctccagtctccataccttcccaaacgcagccctcatactgagctttgaagggtcacccgcatacacacctgagcagaaggctcgatgaggcgctc

SEQ ID NO: 1356 - DNA, 200 bp, Lolium multiflorum
ccgacttccgacaccaaaggggcagacggtggcatctttcaggaagggtctagccatgctcccaaatgctatcgcttctaggttgggtagtaaagtcaaactctcgtggaagcttacgggcattacaaagtcggacaaccagggatatgtgttagcgtatgaaacaccggaaggagttgtttcagtgcaggctaaaagtg

SEQ ID NO: 1357 - DNA, 200 bp, Lolium multiflorum
cacttttagcctgcactgaaacaactccttccggtgtttcatacgctaacacatatccctggttgtccgactttgtaatgcccgtaagcttccacgagagtttgactttactacccaacctagaagcgatagcatttgggagcatggctagacccttcctgaaagatgccaccgtctgcccctttggtgtcggaagtcgg

SEQ ID NO: 1358 - DNA, 200 bp, Lolium multiflorum
gttgtttcagtgcaggctaaaagtgttatcatgaccattccgtcatatattgctagtgaaatcttgcgcccactttcgagtgatgcagcagatggtctctcaaaattttattatccaccggttgctgctgtaactgtttcatatccaacagaagctattagaaagaatgcttaattgatggggagctccagggtttcggc

SEQ ID NO: 1359 - DNA, 200 bp, Lolium multiflorum
gccgaaaccctggagctccccatcaattaagcattctttctaatagcttctgttggatatgaaacagttacagcagcaaccggtggataataaaattttgagagaccatctgctgcatcactcgaaagtgggcgcaagatttcactagcaatatatgacggaatggtcatgataacacttttagcctgcactgaaacaac

SEQ ID NO: 1360 - DNA, 200 bp, Lolium multiflorum
tgatggggagctccagggtttcggccagttgcatccacgtagccaaggagttgagactttagggacaatatatagctcttctctctttccgaatcgtgctcctgctggaagagtgttacttctgaactatatcgggggtgctacaaatacagggatcgtctccaagactgagagtgacttggtggaagcagttgatcgtg

SEQ ID NO: 1361 - DNA, 200 bp, Lolium multiflorum
cacgatcaactgcttccaccaagtcactctcagtcttggagacgatccctgtatttgtagcacccccgatatagttcagaagtaacactcttccagcaggagcacgattcggaaagagagaagagctatatattgtccctaaagtctcaactccttggctacgtggatgcaactggccgaaaccctggagctccccatca

SEQ ID NO: 1362 - DNA, 200 bp, Lolium multiflorum
gacttggtggaagcagttgatcgtgacctcagaaaaatgttgataaatcctacagcaccagaccctttagccttaggcgtccgagtgtggccacaagccattccacagtttttgattgggcaccttgatcgccttgatgcggcaaaatctgccttggccagaggcggctgcagtgggttgtttctaggaggaaactatgt

SEQ ID NO: 1363 - DNA, 200 bp, Lolium multiflorum
acatagtttcctcctagaaacaacccactgcagccgcctctggccaaggcagattttgccgcatcaaggcgatcaaggtgcccaatcaaaaactgtggaatggcttgtggccacactcggacgcctaaggctaaagggtctggtgctgtaggatttatcaacatttttctgaggtcacgatcaactgcttccaccaagtc

SEQ ID NO: 1364 - DNA, 200 bp, Lolium multiflorum
ggttgtttctaggaggaaactatgtagcaggagttgccttgggccgatgcatcgagggtgcgtacgagagtgcctcagaagtatctgacttcttgaccaagtatgcctacaagtgatgaaagaagtgtaattcatcatcttgctgcatatttgaggtgcggccagaattagtaataattcggaaaatcttgtaatcttct

SEQ ID NO: 1365 - DNA, 200 bp, Lolium multiflorum
agaagattacaagattttccgaattattactaattctggccgcacctcaaatatgcagcaagatgatgaattacacttctttcatcacttgtaggcatacttggtcaagaagtcagatacttctgaggcactctcgtacgcaccctcgatgcatcggcccaaggcaactcctgctacatagtttcctcctagaaacaacc

SEQ ID NO: 1366 - DNA, 200 bp, Lolium multiflorum
ggttttggtattattctactaataattcgtggcatttttatgtagggacaatatatagctcttctctctttccaaatcgtgctcctgctggaagagtgttacttctgaactatatcggtggtgctacaaatacagggatcgtctccaaggttctctcgacctgctggatactcatgtcattttcttattgcgtgatacca

SEQ ID NO: 1367 - DNA, 200 bp, Lolium multiflorum
tggtatcacgcaataagaaaatgacatgagtatccagcaggtcgagagaaccttggagacgatccctgtatttgtagcaccaccgatatagttcagaagtaacactcttccagcaggagcacgatttggaaagagagaagagctatatattgtccctacataaaaatgccacgaattattagtagaataataccaaaacc

SEQ ID NO: 1368 - DNA, 200 bp, Lolium multiflorum
gtcattttcttattgcgtgataccaggttacagtattcagttagtgttggtcacctattcatttatgattaatataaataactggactgcatttttcacccccagctgcaattgtgaatacaaatagattaaatggtctgcttagatgctacattcaatctcaatagtattgttagattttttttttggctggccatatt

SEQ ID NO: 1369 - DNA, 200 bp, Lolium multiflorum
aatatggccagccaaaaaaaaaatctaacaatactattgagattgaatgtagcatctaagcagaccatttaatctatttgtattcacaattgcagctgggggtgaaaaatgcagtccagttatttatattaatcataaatgaataggtgaccaacactaactgaatactgtaacctggtatcacgcaataagaaaatgac

SEQ ID NO: 1370 - DNA, 200 bp, Lolium multiflorum
gattttttttttggctggccatatttatactgatcccattttgtttgcagactgagagtgacttggtggaagcagttgatcgtgacctcagaaaaatgttgataaatcctacagcaccagaccctttagccttaggtgtccgagtgtggccacaagccattccacagtttttgattgggcaccttgatcgccttgatgcg

SEQ ID NO: 1371 - DNA, 200 bp, Lolium multiflorum
cgcatcaaggcgatcaaggtgcccaatcaaaaactgtggaatggcttgtggccacactcggacacctaaggctaaagggtctggtgctgtaggatttatcaacatttttctgaggtcacgatcaactgcttccaccaagtcactctcagtctgcaaacaaaatgggatcagtataaatatggccagccaaaaaaaaaatc

SEQ ID NO: 1372 - DNA, 200 bp, Lolium multiflorum
tgggcaccttgatcgccttgatgcggcaaaatctgccttggccagaggcggctgcagtgggttgttcctaggaggaaactatgtagcaggagttgccttgggccgatgcatcgagggtgcgtacgagagtgcctcagaagtatctgacttcttgaccaagtatgcctacaagtgatgaaagaagtgtaattcatcatctt

SEQ ID NO: 1373 - DNA, 200 bp, Lolium multiflorum
aagatgatgaattacacttctttcatcacttgtaggcatacttggtcaagaagtcagatacttctgaggcactctcgtacgcaccctcgatgcatcggcccaaggcaactcctgctacatagtttcctcctaggaacaacccactgcagccgcctctggccaaggcagattttgccgcatcaaggcgatcaaggtgccca

SEQ ID NO: 1374 - DNA, 200 bp, Lolium multiflorum
tcaggggcgtgaggagtcggtggaggaatttgtgcgccgcaacctgggtgcggaggtctttgagcgcctcatcgagcctttctgctcaggtagtgtgcagtagtatctgtctgttctgttctgctctgcttcctgcattgattccgataataagaatataacatttcgatatcaacgttaggtgtgtatgcgggtgaccc

SEQ ID NO: 1375 - DNA, 200 bp, Lolium multiflorum
gggtcacccgcatacacacctaacgttgatatcgaaatgttatattcttattatcggaatcaatgcaggaagcagagcagaacagaacagacagatactactgcacactacctgagcagaaaggctcgatgaggcgctcaaagacctccgcacccaggttgcggcgcacaaattcctccaccgactcctcacgcccctga

SEQ ID NO: 1376 - DNA, 200 bp, Lolium multiflorum
cgttaggtgtgtatgcgggtgacccttcaaagctcagtatgcgggctgcgtttgggaaggtatggagactggaggagaatggaggcagtattattggtggaaccatcaaggcaattcaggatagaggcaagaaccccaaaccgccgagggatccgtaagtggagactgcaattttctatttagtcagttaactgttccat

SEQ ID NO: 1377 - DNA, 200 bp, Lolium multiflorum
atggaacagttaactgactaaatagaaaattgcagtctccacttacggatccctcggcggtttggggttcttgcctctatcctgaattgccttgatggttccaccaataatactgcctccattctcctccagtctccataccttcccaaacgcagcccgcatactgagctttgaagggtcacccgcatacacacctaacg

SEQ ID NO: 1378 - DNA, 200 bp, Lolium multiflorum
ttgaaacaacttgtgacctctgaccttagaaagctcttgggtgtagaggggcagccaacttttgtgagacatatacattggaaaaatgcttttcctctgtatggccatgattatgatttggcattggaagctataggaaagatggagaatgatcttccagggttcttctatgcaggaaataacaaggatggcttggctgt

SEQ ID NO: 1379 - DNA, 200 bp, Lolium multiflorum
acagccaagccatccttgttatttcctgcatagaagaaccctggaagatcattctccatctttcctatagcttccaatgccaaatcataatcatggccatacagaggaaaagcatttttccaatgtatatgtctcacaaaagttggctgcccctctacacccaagagctttctaaggtcagaggtcacaagttgtttcaa

SEQ ID NO: 1380 - DNA, 200 bp, Lolium multiflorum
ttgatatttattatgcaggtggattatctgccgttatccctcatggtaacagcttttaagaaggaagatgtcaaaagacccctggaaggatttggggtgttggtaccctataaggaacagcaaaaacatggtctgaaaacccttggaaccctcttctcctctatgatgttcccagatcgagctcctaatgaccaacactt

SEQ ID NO: 1381 - DNA, 200 bp, Lolium multiflorum
aagtgttggtcattaggagctcgatctgggaacatcatagaggagaagagggttccaagggttttcagaccatgtttttgctgttccttatagggtaccaacaccccaaatccttccaggggtcttttgacatcttccttcttaaaagctgttaccatgagggataacggcagataatccacctgcataataaatatcaa

SEQ ID NO: 1382 - DNA, 21 bp, Unknown
  Found in multiple species
tttgtagcacctccaatgtag

SEQ ID NO: 1383 - DNA, 21 bp, Unknown
  Found in multiple species
tggctatatctgggaagaggg

SEQ ID NO: 1384 - DNA, 21 bp, Unknown
  Found in multiple species
tcttcccagatatagccatcg

SEQ ID NO: 1385 - DNA, 21 bp, Unknown
  Found in multiple species
tacattggaggtgctacaaat

SEQ ID NO: 1386 - DNA, 21 bp, Unknown
  Found in multiple species
gatggctatatctgggaagag

SEQ ID NO: 1387 - DNA, 21 bp, Unknown
  Found in multiple species
cttcccagatatagccatcgg

SEQ ID NO: 1388 - DNA, 21 bp, Unknown
  Found in multiple species
ctcttcccagatatagccatc

SEQ ID NO: 1389 - DNA, 21 bp, Unknown
  Found in multiple species
ctacattggaggtgctacaaa

SEQ ID NO: 1390 - DNA, 21 bp, Unknown
  Found in multiple species
cgatggctatatctgggaaga

SEQ ID NO: 1391 - DNA, 21 bp, Unknown
  Found in multiple species
cctcttcccagatatagccat

SEQ ID NO: 1392 - DNA, 21 bp, Unknown
  Found in multiple species
ccgatggctatatctgggaag

SEQ ID NO: 1393 - DNA, 21 bp, Unknown
  Found in multiple species
ccctcttcccagatatagcca

SEQ ID NO: 1394 - DNA, 21 bp, Unknown
  Found in multiple species
atttgtagcacctccaatgta

SEQ ID NO: 1395 - DNA, 21 bp, Unknown
  Found in multiple species
atggctatatctgggaagagg

SEQ ID NO: 1396 - DNA, 21 bp, Unknown
  Found in multiple species
ttttttgatctcatgagcttt

SEQ ID NO: 1397 - DNA, 21 bp, Unknown
  Found in multiple species
tttttgatctcatgagctttc

SEQ ID NO: 1398 - DNA, 21 bp, Unknown
  Found in multiple species
ttttgctctaaggtccagacc

SEQ ID NO: 1399 - DNA, 21 bp, Unknown
  Found in multiple species
ttttgatctcatgagctttcc

SEQ ID NO: 1400 - DNA, 21 bp, Unknown
  Found in multiple species
tttggtcctaacagaaaccgg

SEQ ID NO: 1401 - DNA, 21 bp, Unknown
  Found in multiple species
tttggccatactctcactccc

SEQ ID NO: 1402 - DNA, 21 bp, Unknown
  Found in multiple species
tttggatttatcagaattttt

SEQ ID NO: 1403 - DNA, 21 bp, Unknown
  Found in multiple species
tttggaaaggtctggacctta

SEQ ID NO: 1404 - DNA, 21 bp, Unknown
  Found in multiple species
tttgctctaaggtccagacct

SEQ ID NO: 1405 - DNA, 21 bp, Unknown
  Found in multiple species
tttgatctcatgagctttcct

SEQ ID NO: 1406 - DNA, 21 bp, Unknown
  Found in multiple species
tttgagtgtaccggcgatgat

SEQ ID NO: 1407 - DNA, 21 bp, Unknown
  Found in multiple species
tttgactttactgccaagcct

SEQ ID NO: 1408 - DNA, 21 bp, Unknown
  Found in multiple species
tttctgttaggaccaaagcgg

SEQ ID NO: 1409 - DNA, 21 bp, Unknown
  Found in multiple species
tttctaatattgataagtcgc

SEQ ID NO: 1410 - DNA, 21 bp, Unknown
  Found in multiple species
tttcgcatttggatttatcag

SEQ ID NO: 1411 - DNA, 21 bp, Unknown
  Found in multiple species
tttcctggtaagattagggct

SEQ ID NO: 1412 - DNA, 21 bp, Unknown
  Found in multiple species
tttcctaaaggatccaacagt

SEQ ID NO: 1413 - DNA, 21 bp, Unknown
  Found in multiple species
tttccaaatgcagctttcata

SEQ ID NO: 1414 - DNA, 21 bp, Unknown
  Found in multiple species
tttcaatccactgtcaaccgc

SEQ ID NO: 1415 - DNA, 21 bp, Unknown
  Found in multiple species
tttatcagaatttttctgaga

SEQ ID NO: 1416 - DNA, 21 bp, Unknown
  Found in multiple species
tttaggaaggcgggggtctcg

SEQ ID NO: 1417 - DNA, 21 bp, Unknown
  Found in multiple species
tttactgccaagcctagcagc

SEQ ID NO: 1418 - DNA, 21 bp, Unknown
  Found in multiple species
ttgtagcacctccaatgtagc

SEQ ID NO: 1419 - DNA, 21 bp, Unknown
  Found in multiple species
ttggtcctaacagaaaccggt

SEQ ID NO: 1420 - DNA, 21 bp, Unknown
  Found in multiple species
ttggccatactctcactccca

SEQ ID NO: 1421 - DNA, 21 bp, Unknown
  Found in multiple species
ttggcagtaaagtcaaactat

SEQ ID NO: 1422 - DNA, 21 bp, Unknown
  Found in multiple species
ttggatttatcagaatttttc

SEQ ID NO: 1423 - DNA, 21 bp, Unknown
  Found in multiple species
ttggaaaggtctggaccttag

SEQ ID NO: 1424 - DNA, 21 bp, Unknown
  Found in multiple species
ttggaaactattaggaccctc

SEQ ID NO: 1425 - DNA, 21 bp, Unknown
  Found in multiple species
ttgctgctaggcttggcagta

SEQ ID NO: 1426 - DNA, 21 bp, Unknown
  Found in multiple species
ttgctctaaggtccagacctt

SEQ ID NO: 1427 - DNA, 21 bp, Unknown
  Found in multiple species
ttgcctttggccatactctca

SEQ ID NO: 1428 - DNA, 21 bp, Unknown
  Found in multiple species
ttgcaagtagcctgcttcgtc

SEQ ID NO: 1429 - DNA, 21 bp, Unknown
  Found in multiple species
ttgatcttgagctacattgga

SEQ ID NO: 1430 - DNA, 21 bp, Unknown
  Found in multiple species
ttgatctcatgagctttcctg

SEQ ID NO: 1431 - DNA, 21 bp, Unknown
  Found in multiple species
ttgataagtcgctcaatggtg

SEQ ID NO: 1432 - DNA, 21 bp, Unknown
  Found in multiple species
ttgagtgtaccggcgatgata

SEQ ID NO: 1433 - DNA, 21 bp, Unknown
  Found in multiple species
ttgagtatgaaagctgcattt

SEQ ID NO: 1434 - DNA, 21 bp, Unknown
  Found in multiple species
ttgagctacattggaggtgct

SEQ ID NO: 1435 - DNA, 21 bp, Unknown
  Found in multiple species
ttgagcgacttatcaatatta

SEQ ID NO: 1436 - DNA, 21 bp, Unknown
  Found in multiple species
ttgactttactgccaagccta

SEQ ID NO: 1437 - DNA, 21 bp, Unknown
  Found in multiple species
ttgaagaatttgtgcgccgta

SEQ ID NO: 1438 - DNA, 21 bp, Unknown
  Found in multiple species
ttctgttaggaccaaagcggt

SEQ ID NO: 1439 - DNA, 21 bp, Unknown
  Found in multiple species
ttctgggagtgagagtatggc

SEQ ID NO: 1440 - DNA, 21 bp, Unknown
  Found in multiple species
ttctgataaatccaaatgcga

SEQ ID NO: 1441 - DNA, 21 bp, Unknown
  Found in multiple species
ttctaatattgataagtcgct

SEQ ID NO: 1442 - DNA, 21 bp, Unknown
  Found in multiple species
ttcgcatttggatttatcaga

SEQ ID NO: 1443 - DNA, 21 bp, Unknown
  Found in multiple species
ttcctggtaagattagggctg

SEQ ID NO: 1444 - DNA, 21 bp, Unknown
  Found in multiple species
ttcctaaaggatccaacagtc

SEQ ID NO: 1445 - DNA, 21 bp, Unknown
  Found in multiple species
ttcctaaacctaagggccaga

SEQ ID NO: 1446 - DNA, 21 bp, Unknown
  Found in multiple species
ttcccttttttgatctcatga

SEQ ID NO: 1447 - DNA, 21 bp, Unknown
  Found in multiple species
ttcccagatatagccatcgga

SEQ ID NO: 1448 - DNA, 21 bp, Unknown
  Found in multiple species
ttccaaatgcagctttcatac

SEQ ID NO: 1449 - DNA, 21 bp, Unknown
  Found in multiple species
ttcatcttcactcttttgtaa

SEQ ID NO: 1450 - DNA, 21 bp, Unknown
  Found in multiple species
ttcatacattgcaagtagcct

SEQ ID NO: 1451 - DNA, 21 bp, Unknown
  Found in multiple species
ttcaggaaaggaagaataatc

SEQ ID NO: 1452 - DNA, 21 bp, Unknown
  Found in multiple species
ttcaccattgagcgacttatc

SEQ ID NO: 1453 - DNA, 21 bp, Unknown
  Found in multiple species
ttcaatccactgtcaaccgcc

SEQ ID NO: 1454 - DNA, 21 bp, Unknown
  Found in multiple species
ttattcttcctttcctgaata

SEQ ID NO: 1455 - DNA, 21 bp, Unknown
  Found in multiple species
ttatgttacctaccgccattg

SEQ ID NO: 1456 - DNA, 21 bp, Unknown
  Found in multiple species
ttatcagaatttttctgagat

SEQ ID NO: 1457 - DNA, 21 bp, Unknown
  Found in multiple species
ttatcaatattagaaagtgtc

SEQ ID NO: 1458 - DNA, 21 bp, Unknown
  Found in multiple species
ttaggtttaggaaggcggggg

SEQ ID NO: 1459 - DNA, 21 bp, Unknown
  Found in multiple species
ttaggaccctcttcccagata

SEQ ID NO: 1460 - DNA, 21 bp, Unknown
  Found in multiple species
ttaggaccaaagcggttgtca

SEQ ID NO: 1461 - DNA, 21 bp, Unknown
  Found in multiple species
ttaggaaggcgggggtctcga

SEQ ID NO: 1462 - DNA, 21 bp, Unknown
  Found in multiple species
ttagagcaaaagggtggtagt

SEQ ID NO: 1463 - DNA, 21 bp, Unknown
  Found in multiple species
ttactgccaagcctagcagca

SEQ ID NO: 1464 - DNA, 21 bp, Unknown
  Found in multiple species
ttactatggcggttgacagtg

SEQ ID NO: 1465 - DNA, 21 bp, Unknown
  Found in multiple species
ttacggcgcacaaattcttca

SEQ ID NO: 1466 - DNA, 21 bp, Unknown
  Found in multiple species
ttacctaccgccattgctgct

SEQ ID NO: 1467 - DNA, 21 bp, Unknown
  Found in multiple species
ttaccaggaaagctcatgaga

SEQ ID NO: 1468 - DNA, 21 bp, Unknown
  Found in multiple species
ttacaaaagagtgaagatgaa

SEQ ID NO: 1469 - DNA, 21 bp, Unknown
  Found in multiple species
tgttggatcctttaggaaagg

SEQ ID NO: 1470 - DNA, 21 bp, Unknown
  Found in multiple species
tgttaggaccaaagcggttgt

SEQ ID NO: 1471 - DNA, 21 bp, Unknown
  Found in multiple species
tgttacctaccgccattgctg

SEQ ID NO: 1472 - DNA, 21 bp, Unknown
  Found in multiple species
tgtgcttactatggcggttga

SEQ ID NO: 1473 - DNA, 21 bp, Unknown
  Found in multiple species
tgtcaaccgccatagtaagca

SEQ ID NO: 1474 - DNA, 21 bp, Unknown
  Found in multiple species
tgtattcaccattgagcgact

SEQ ID NO: 1475 - DNA, 21 bp, Unknown
  Found in multiple species
tgtagctcaagatcaaggtcc

SEQ ID NO: 1476 - DNA, 21 bp, Unknown
  Found in multiple species
tgtagcacctccaatgtagct

SEQ ID NO: 1477 - DNA, 21 bp, Unknown
  Found in multiple species
tgtaccggcgatgatactacc

SEQ ID NO: 1478 - DNA, 21 bp, Unknown
  Found in multiple species
tggtcctaacagaaaccggtc

SEQ ID NO: 1479 - DNA, 21 bp, Unknown
  Found in multiple species
tggtagtatcatcgccggtac

SEQ ID NO: 1480 - DNA, 21 bp, Unknown
  Found in multiple species
tggtaagattagggctggtct

SEQ ID NO: 1481 - DNA, 21 bp, Unknown
  Found in multiple species
tggtaaattaaggcctgttcc

SEQ ID NO: 1482 - DNA, 21 bp, Unknown
  Found in multiple species
tgggagtgagagtatggccaa

SEQ ID NO: 1483 - DNA, 21 bp, Unknown
  Found in multiple species
tgggaagagggtcctaatagt

SEQ ID NO: 1484 - DNA, 21 bp, Unknown
  Found in multiple species
tggcggttgacagtggattga

SEQ ID NO: 1485 - DNA, 21 bp, Unknown
  Found in multiple species
tggcggtaggtaacataatga

SEQ ID NO: 1486 - DNA, 21 bp, Unknown
  Found in multiple species
tggcccttaggtttaggaagg

SEQ ID NO: 1487 - DNA, 21 bp, Unknown
  Found in multiple species
tggccatactctcactcccag

SEQ ID NO: 1488 - DNA, 21 bp, Unknown
  Found in multiple species
tggcagtaaagtcaaactatc

SEQ ID NO: 1489 - DNA, 21 bp, Unknown
  Found in multiple species
tggatttatcagaatttttct

SEQ ID NO: 1490 - DNA, 21 bp, Unknown
  Found in multiple species
tggagtccgatggctatatct

SEQ ID NO: 1491 - DNA, 21 bp, Unknown
  Found in multiple species
tggaggattattcttcctttc

SEQ ID NO: 1492 - DNA, 21 bp, Unknown
  Found in multiple species
tggaccttagagcaaaagggt

SEQ ID NO: 1493 - DNA, 21 bp, Unknown
  Found in multiple species
tggaccggtttctgttaggac

SEQ ID NO: 1494 - DNA, 21 bp, Unknown
  Found in multiple species
tggacactttctaatattgat

SEQ ID NO: 1495 - DNA, 21 bp, Unknown
  Found in multiple species
tggaatggtaaattaaggcct

SEQ ID NO: 1496 - DNA, 21 bp, Unknown
  Found in multiple species
tggaaaggtctggaccttaga

SEQ ID NO: 1497 - DNA, 21 bp, Unknown
  Found in multiple species
tggaaactattaggaccctct

SEQ ID NO: 1498 - DNA, 21 bp, Unknown
  Found in multiple species
tgcttactatggcggttgaca

SEQ ID NO: 1499 - DNA, 21 bp, Unknown
  Found in multiple species
tgctgctaggcttggcagtaa

SEQ ID NO: 1500 - DNA, 21 bp, Unknown
  Found in multiple species
tgctctaaggtccagaccttt

SEQ ID NO: 1501 - DNA, 21 bp, Unknown
  Found in multiple species
tgctaggcttggcagtaaagt

SEQ ID NO: 1502 - DNA, 21 bp, Unknown
  Found in multiple species
tgcctttggccatactctcac

SEQ ID NO: 1503 - DNA, 21 bp, Unknown
  Found in multiple species
tgcctttcgcatttggattta

SEQ ID NO: 1504 - DNA, 21 bp, Unknown
  Found in multiple species
tgccaagcctagcagcaatgg

SEQ ID NO: 1505 - DNA, 21 bp, Unknown
  Found in multiple species
tgcatttggaaaggtctggac

SEQ ID NO: 1506 - DNA, 21 bp, Unknown
  Found in multiple species
tgcagctttcatactcaactt

SEQ ID NO: 1507 - DNA, 21 bp, Unknown
  Found in multiple species
tgcaagtagcctgcttcgtcc

SEQ ID NO: 1508 - DNA, 21 bp, Unknown
  Found in multiple species
tgatcttgagctacattggag

SEQ ID NO: 1509 - DNA, 21 bp, Unknown
  Found in multiple species
tgatctcatgagctttcctgg

SEQ ID NO: 1510 - DNA, 21 bp, Unknown
  Found in multiple species
tgatactaccacccttttgct

SEQ ID NO: 1511 - DNA, 21 bp, Unknown
  Found in multiple species
tgataagtcgctcaatggtga

SEQ ID NO: 1512 - DNA, 21 bp, Unknown
  Found in multiple species
tgataaatccaaatgcgaaag

SEQ ID NO: 1513 - DNA, 21 bp, Unknown
  Found in multiple species
tgagtgtaccggcgatgatac

SEQ ID NO: 1514 - DNA, 21 bp, Unknown
  Found in multiple species
tgagtatgaaagctgcatttg

SEQ ID NO: 1515 - DNA, 21 bp, Unknown
  Found in multiple species
tgagctttcctggtaagatta

SEQ ID NO: 1516 - DNA, 21 bp, Unknown
  Found in multiple species
tgagctacattggaggtgcta

SEQ ID NO: 1517 - DNA, 21 bp, Unknown
  Found in multiple species
tgagcgacttatcaatattag

SEQ ID NO: 1518 - DNA, 21 bp, Unknown
  Found in multiple species
tgagatcaaaaaagggaaggt

SEQ ID NO: 1519 - DNA, 21 bp, Unknown
  Found in multiple species
tgagagtatggccaaaggcaa

SEQ ID NO: 1520 - DNA, 21 bp, Unknown
  Found in multiple species
tgactttactgccaagcctag

SEQ ID NO: 1521 - DNA, 21 bp, Unknown
  Found in multiple species
tgacaaccgctttggtcctaa

SEQ ID NO: 1522 - DNA, 21 bp, Unknown
  Found in multiple species
tgaagaatttgtgcgccgtaa

SEQ ID NO: 1523 - DNA, 21 bp, Unknown
  Found in multiple species
tgaaagctgcatttggaaagg

SEQ ID NO: 1524 - DNA, 21 bp, Unknown
  Found in multiple species
tctttcaatccactgtcaacc

SEQ ID NO: 1525 - DNA, 21 bp, Unknown
  Found in multiple species
tcttgagctacattggaggtg

SEQ ID NO: 1526 - DNA, 21 bp, Unknown
  Found in multiple species
tcttaccaggaaagctcatga

SEQ ID NO: 1527 - DNA, 21 bp, Unknown
  Found in multiple species
tctgttaggaccaaagcggtt

SEQ ID NO: 1528 - DNA, 21 bp, Unknown
  Found in multiple species
tctgggagtgagagtatggcc

SEQ ID NO: 1529 - DNA, 21 bp, Unknown
  Found in multiple species
tctgggaagagggtcctaata

SEQ ID NO: 1530 - DNA, 21 bp, Unknown
  Found in multiple species
tctggcccttaggtttaggaa

SEQ ID NO: 1531 - DNA, 21 bp, Unknown
  Found in multiple species
tctggaccttagagcaaaagg

SEQ ID NO: 1532 - DNA, 21 bp, Unknown
  Found in multiple species
tctgataaatccaaatgcgaa

SEQ ID NO: 1533 - DNA, 21 bp, Unknown
  Found in multiple species
tctcatgagctttcctggtaa

SEQ ID NO: 1534 - DNA, 21 bp, Unknown
  Found in multiple species
tctcagaaaaattctgataaa

SEQ ID NO: 1535 - DNA, 21 bp, Unknown
  Found in multiple species
tctaatattgataagtcgctc

SEQ ID NO: 1536 - DNA, 21 bp, Unknown
  Found in multiple species
tctaaggtccagacctttcca

SEQ ID NO: 1537 - DNA, 21 bp, Unknown
  Found in multiple species
tcgcatttggatttatcagaa

SEQ ID NO: 1538 - DNA, 21 bp, Unknown
  Found in multiple species
tcgagacccccgccttcctaa

SEQ ID NO: 1539 - DNA, 21 bp, Unknown
  Found in multiple species
tcctgtgcttactatggcggt

SEQ ID NO: 1540 - DNA, 21 bp, Unknown
  Found in multiple species
tcctggtaagattagggctgg

SEQ ID NO: 1541 - DNA, 21 bp, Unknown
  Found in multiple species
tcctaatagtttccaaccctc

SEQ ID NO: 1542 - DNA, 21 bp, Unknown
  Found in multiple species
tcctaacagaaaccggtccat

SEQ ID NO: 1543 - DNA, 21 bp, Unknown
  Found in multiple species
tcctaaaggatccaacagtct

SEQ ID NO: 1544 - DNA, 21 bp, Unknown
  Found in multiple species
tcctaaacctaagggccagac

SEQ ID NO: 1545 - DNA, 21 bp, Unknown
  Found in multiple species
tccgcaagttcatcttcactc

SEQ ID NO: 1546 - DNA, 21 bp, Unknown
  Found in multiple species
tccgatggctatatctgggaa

SEQ ID NO: 1547 - DNA, 21 bp, Unknown
  Found in multiple species
tcccttttttgatctcatgag

SEQ ID NO: 1548 - DNA, 21 bp, Unknown
  Found in multiple species
tcccagatatagccatcggac

SEQ ID NO: 1549 - DNA, 21 bp, Unknown
  Found in multiple species
tccagacctttccaaatgcag

SEQ ID NO: 1550 - DNA, 21 bp, Unknown
  Found in multiple species
tccactgtcaaccgccatagt

SEQ ID NO: 1551 - DNA, 21 bp, Unknown
  Found in multiple species
tccaatgtagctcaagatcaa

SEQ ID NO: 1552 - DNA, 21 bp, Unknown
  Found in multiple species
tccaacagtctggcccttagg

SEQ ID NO: 1553 - DNA, 21 bp, Unknown
  Found in multiple species
tccaaatgcgaaaggcagccg

SEQ ID NO: 1554 - DNA, 21 bp, Unknown
  Found in multiple species
tccaaatgcagctttcatact

SEQ ID NO: 1555 - DNA, 21 bp, Unknown
  Found in multiple species
tcattatgttacctaccgcca

SEQ ID NO: 1556 - DNA, 21 bp, Unknown
  Found in multiple species
tcatgagctttcctggtaaga

SEQ ID NO: 1557 - DNA, 21 bp, Unknown
  Found in multiple species
tcatgagatcaaaaaagggaa

SEQ ID NO: 1558 - DNA, 21 bp, Unknown
  Found in multiple species
tcatgacaaccgctttggtcc

SEQ ID NO: 1559 - DNA, 21 bp, Unknown
  Found in multiple species
tcatcttcactcttttgtaat

SEQ ID NO: 1560 - DNA, 21 bp, Unknown
  Found in multiple species
tcatacattgcaagtagcctg

SEQ ID NO: 1561 - DNA, 21 bp, Unknown
  Found in multiple species
tcaggaaaggaagaataatcc

SEQ ID NO: 1562 - DNA, 21 bp, Unknown
  Found in multiple species
tcagaatttttctgagatcct

SEQ ID NO: 1563 - DNA, 21 bp, Unknown
  Found in multiple species
tcagaaaaattctgataaatc

SEQ ID NO: 1564 - DNA, 21 bp, Unknown
  Found in multiple species
tcaccattgagcgacttatca

SEQ ID NO: 1565 - DNA, 21 bp, Unknown
  Found in multiple species
tcaatccactgtcaaccgcca

SEQ ID NO: 1566 - DNA, 21 bp, Unknown
  Found in multiple species
tcaaccgccatagtaagcaca

SEQ ID NO: 1567 - DNA, 21 bp, Unknown
  Found in multiple species
tcaaacacccgatggaccggt

SEQ ID NO: 1568 - DNA, 21 bp, Unknown
  Found in multiple species
tcaaaaaagggaaggtccgta

SEQ ID NO: 1569 - DNA, 21 bp, Unknown
  Found in multiple species
tattgataagtcgctcaatgg

SEQ ID NO: 1570 - DNA, 21 bp, Unknown
  Found in multiple species
tattcttcctttcctgaatag

SEQ ID NO: 1571 - DNA, 21 bp, Unknown
  Found in multiple species
tattcaggaaaggaagaataa

SEQ ID NO: 1572 - DNA, 21 bp, Unknown
  Found in multiple species
tattcaccattgagcgactta

SEQ ID NO: 1573 - DNA, 21 bp, Unknown
  Found in multiple species
tattaggaccctcttcccaga

SEQ ID NO: 1574 - DNA, 21 bp, Unknown
  Found in multiple species
tattacaaaagagtgaagatg

SEQ ID NO: 1575 - DNA, 21 bp, Unknown
  Found in multiple species
tatgttacctaccgccattgc

SEQ ID NO: 1576 - DNA, 21 bp, Unknown
  Found in multiple species
tatggcggttgacagtggatt

SEQ ID NO: 1577 - DNA, 21 bp, Unknown
  Found in multiple species
tatgaaagctgcatttggaaa

SEQ ID NO: 1578 - DNA, 21 bp, Unknown
  Found in multiple species
tatctgggaagagggtcctaa

SEQ ID NO: 1579 - DNA, 21 bp, Unknown
  Found in multiple species
tatcatcgccggtacactcaa

SEQ ID NO: 1580 - DNA, 21 bp, Unknown
  Found in multiple species
tatcagaatttttctgagatc

SEQ ID NO: 1581 - DNA, 21 bp, Unknown
  Found in multiple species
tatcaatattagaaagtgtcc

SEQ ID NO: 1582 - DNA, 21 bp, Unknown
  Found in multiple species
tatcaaacacccgatggaccg

SEQ ID NO: 1583 - DNA, 21 bp, Unknown
  Found in multiple species
tatatctgggaagagggtcct

SEQ ID NO: 1584 - DNA, 21 bp, Unknown
  Found in multiple species
tatagccatcggactccatgg

SEQ ID NO: 1585 - DNA, 21 bp, Unknown
  Found in multiple species
tagtttgactttactgccaag

SEQ ID NO: 1586 - DNA, 21 bp, Unknown
  Found in multiple species
tagtatcatcgccggtacact

SEQ ID NO: 1587 - DNA, 21 bp, Unknown
  Found in multiple species
taggtttaggaaggcgggggt

SEQ ID NO: 1588 - DNA, 21 bp, Unknown
  Found in multiple species
taggcttggcagtaaagtcaa

SEQ ID NO: 1589 - DNA, 21 bp, Unknown
  Found in multiple species
taggaccttgatcttgagcta

SEQ ID NO: 1590 - DNA, 21 bp, Unknown
  Found in multiple species
taggaccctcttcccagatat

SEQ ID NO: 1591 - DNA, 21 bp, Unknown
  Found in multiple species
taggaccaaagcggttgtcat

SEQ ID NO: 1592 - DNA, 21 bp, Unknown
  Found in multiple species
taggaaggcgggggtctcgag

SEQ ID NO: 1593 - DNA, 21 bp, Unknown
  Found in multiple species
tagctcaagatcaaggtccta

SEQ ID NO: 1594 - DNA, 21 bp, Unknown
  Found in multiple species
tagccatcggactccatggta

SEQ ID NO: 1595 - DNA, 21 bp, Unknown
  Found in multiple species
tagcagcaatggcggtaggta

SEQ ID NO: 1596 - DNA, 21 bp, Unknown
  Found in multiple species
tagcacctccaatgtagctca

SEQ ID NO: 1597 - DNA, 21 bp, Unknown
  Found in multiple species
tagagcaaaagggtggtagta

SEQ ID NO: 1598 - DNA, 21 bp, Unknown
  Found in multiple species
tactgccaagcctagcagcaa

SEQ ID NO: 1599 - DNA, 21 bp, Unknown
  Found in multiple species
tactatggcggttgacagtgg

SEQ ID NO: 1600 - DNA, 21 bp, Unknown
  Found in multiple species
tactaccacccttttgctcta

SEQ ID NO: 1601 - DNA, 21 bp, Unknown
  Found in multiple species
tacggcgcacaaattcttcaa

SEQ ID NO: 1602 - DNA, 21 bp, Unknown
  Found in multiple species
tacggaccttcccttttttga

SEQ ID NO: 1603 - DNA, 21 bp, Unknown
  Found in multiple species
tacctaccgccattgctgcta

SEQ ID NO: 1604 - DNA, 21 bp, Unknown
  Found in multiple species
taccggcgatgatactaccac

SEQ ID NO: 1605 - DNA, 21 bp, Unknown
  Found in multiple species
taccgccattgctgctaggct

SEQ ID NO: 1606 - DNA, 21 bp, Unknown
  Found in multiple species
taccatggagtccgatggcta

SEQ ID NO: 1607 - DNA, 21 bp, Unknown
  Found in multiple species
taccaggaaagctcatgagat

SEQ ID NO: 1608 - DNA, 21 bp, Unknown
  Found in multiple species
taccacccttttgctctaagg

SEQ ID NO: 1609 - DNA, 21 bp, Unknown
  Found in multiple species
tacattgcaagtagcctgctt

SEQ ID NO: 1610 - DNA, 21 bp, Unknown
  Found in multiple species
tacaaaagagtgaagatgaac

SEQ ID NO: 1611 - DNA, 21 bp, Unknown
  Found in multiple species
taatcttaccaggaaagctca

SEQ ID NO: 1612 - DNA, 21 bp, Unknown
  Found in multiple species
taatattgataagtcgctcaa

SEQ ID NO: 1613 - DNA, 21 bp, Unknown
  Found in multiple species
taagtcgctcaatggtgaata

SEQ ID NO: 1614 - DNA, 21 bp, Unknown
  Found in multiple species
taaggtccagacctttccaaa

SEQ ID NO: 1615 - DNA, 21 bp, Unknown
  Found in multiple species
taagggccagactgttggatc

SEQ ID NO: 1616 - DNA, 21 bp, Unknown
  Found in multiple species
taagattagggctggtcttgg

SEQ ID NO: 1617 - DNA, 21 bp, Unknown
  Found in multiple species
taacagaaaccggtccatcgg

SEQ ID NO: 1618 - DNA, 21 bp, Unknown
  Found in multiple species
taaattaaggcctgttccttc

SEQ ID NO: 1619 - DNA, 21 bp, Unknown
  Found in multiple species
taaatccaaatgcgaaaggca

SEQ ID NO: 1620 - DNA, 21 bp, Unknown
  Found in multiple species
taaaggatccaacagtctggc

SEQ ID NO: 1621 - DNA, 21 bp, Unknown
  Found in multiple species
taaacctaagggccagactgt

SEQ ID NO: 1622 - DNA, 21 bp, Unknown
  Found in multiple species
gtttgactttactgccaagcc

SEQ ID NO: 1623 - DNA, 21 bp, Unknown
  Found in multiple species
gtttctgttaggaccaaagcg

SEQ ID NO: 1624 - DNA, 21 bp, Unknown
  Found in multiple species
gtttaggaaggcgggggtctc

SEQ ID NO: 1625 - DNA, 21 bp, Unknown
  Found in multiple species
gttggaaactattaggaccct

SEQ ID NO: 1626 - DNA, 21 bp, Unknown
  Found in multiple species
gttgagtatgaaagctgcatt

SEQ ID NO: 1627 - DNA, 21 bp, Unknown
  Found in multiple species
gttgaagaatttgtgcgccgt

SEQ ID NO: 1628 - DNA, 21 bp, Unknown
  Found in multiple species
gttctgggagtgagagtatgg

SEQ ID NO: 1629 - DNA, 21 bp, Unknown
  Found in multiple species
gttcatcttcactcttttgta

SEQ ID NO: 1630 - DNA, 21 bp, Unknown
  Found in multiple species
gttaggaccaaagcggttgtc

SEQ ID NO: 1631 - DNA, 21 bp, Unknown
  Found in multiple species
gttacctaccgccattgctgc

SEQ ID NO: 1632 - DNA, 21 bp, Unknown
  Found in multiple species
gtgtaccggcgatgatactac

SEQ ID NO: 1633 - DNA, 21 bp, Unknown
  Found in multiple species
gtggtagtatcatcgccggta

SEQ ID NO: 1634 - DNA, 21 bp, Unknown
  Found in multiple species
gtggaggattattcttccttt

SEQ ID NO: 1635 - DNA, 21 bp, Unknown
  Found in multiple species
gtgcttactatggcggttgac

SEQ ID NO: 1636 - DNA, 21 bp, Unknown
  Found in multiple species
gtgagagtatggccaaaggca

SEQ ID NO: 1637 - DNA, 21 bp, Unknown
  Found in multiple species
gtctggcccttaggtttagga

SEQ ID NO: 1638 - DNA, 21 bp, Unknown
  Found in multiple species
gtctggaccttagagcaaaag

SEQ ID NO: 1639 - DNA, 21 bp, Unknown
  Found in multiple species
gtcctaatagtttccaaccct

SEQ ID NO: 1640 - DNA, 21 bp, Unknown
  Found in multiple species
gtcctaacagaaaccggtcca

SEQ ID NO: 1641 - DNA, 21 bp, Unknown
  Found in multiple species
gtccgatggctatatctggga

SEQ ID NO: 1642 - DNA, 21 bp, Unknown
  Found in multiple species
gtccagacctttccaaatgca

SEQ ID NO: 1643 - DNA, 21 bp, Unknown
  Found in multiple species
gtcatgacaaccgctttggtc

SEQ ID NO: 1644 - DNA, 21 bp, Unknown
  Found in multiple species
gtcaaccgccatagtaagcac

SEQ ID NO: 1645 - DNA, 21 bp, Unknown
  Found in multiple species
gtattcaccattgagcgactt

SEQ ID NO: 1646 - DNA, 21 bp, Unknown
  Found in multiple species
gtatgaaagctgcatttggaa

SEQ ID NO: 1647 - DNA, 21 bp, Unknown
  Found in multiple species
gtatcatcgccggtacactca

SEQ ID NO: 1648 - DNA, 21 bp, Unknown
  Found in multiple species
gtagtatcatcgccggtacac

SEQ ID NO: 1649 - DNA, 21 bp, Unknown
  Found in multiple species
gtagctcaagatcaaggtcct

SEQ ID NO: 1650 - DNA, 21 bp, Unknown
  Found in multiple species
gtagcacctccaatgtagctc

SEQ ID NO: 1651 - DNA, 21 bp, Unknown
  Found in multiple species
gtaccggcgatgatactacca

SEQ ID NO: 1652 - DNA, 21 bp, Unknown
  Found in multiple species
gtaagattagggctggtcttg

SEQ ID NO: 1653 - DNA, 21 bp, Unknown
  Found in multiple species
gtaaattaaggcctgttcctt

SEQ ID NO: 1654 - DNA, 21 bp, Unknown
  Found in multiple species
ggtttctgttaggaccaaagc

SEQ ID NO: 1655 - DNA, 21 bp, Unknown
  Found in multiple species
ggtttaggaaggcgggggtct

SEQ ID NO: 1656 - DNA, 21 bp, Unknown
  Found in multiple species
ggttggaaactattaggaccc

SEQ ID NO: 1657 - DNA, 21 bp, Unknown
  Found in multiple species
ggttgacagtggattgaaaga

SEQ ID NO: 1658 - DNA, 21 bp, Unknown
  Found in multiple species
ggtggtagtatcatcgccggt

SEQ ID NO: 1659 - DNA, 21 bp, Unknown
  Found in multiple species
ggtggaggattattcttcctt

SEQ ID NO: 1660 - DNA, 21 bp, Unknown
  Found in multiple species
ggtctggaccttagagcaaaa

SEQ ID NO: 1661 - DNA, 21 bp, Unknown
  Found in multiple species
ggtcctaatagtttccaaccc

SEQ ID NO: 1662 - DNA, 21 bp, Unknown
  Found in multiple species
ggtcctaacagaaaccggtcc

SEQ ID NO: 1663 - DNA, 21 bp, Unknown
  Found in multiple species
ggtccagacctttccaaatgc

SEQ ID NO: 1664 - DNA, 21 bp, Unknown
  Found in multiple species
ggtagtatcatcgccggtaca

SEQ ID NO: 1665 - DNA, 21 bp, Unknown
  Found in multiple species
ggtaagattagggctggtctt

SEQ ID NO: 1666 - DNA, 21 bp, Unknown
  Found in multiple species
ggtaaattaaggcctgttcct

SEQ ID NO: 1667 - DNA, 21 bp, Unknown
  Found in multiple species
gggttggaaactattaggacc

SEQ ID NO: 1668 - DNA, 21 bp, Unknown
  Found in multiple species
gggtggtagtatcatcgccgg

SEQ ID NO: 1669 - DNA, 21 bp, Unknown
  Found in multiple species
gggtcctaatagtttccaacc

SEQ ID NO: 1670 - DNA, 21 bp, Unknown
  Found in multiple species
gggccagactgttggatcctt

SEQ ID NO: 1671 - DNA, 21 bp, Unknown
  Found in multiple species
gggagtgagagtatggccaaa

SEQ ID NO: 1672 - DNA, 21 bp, Unknown
  Found in multiple species
gggaagagggtcctaatagtt

SEQ ID NO: 1673 - DNA, 21 bp, Unknown
  Found in multiple species
ggcttggcagtaaagtcaaac

SEQ ID NO: 1674 - DNA, 21 bp, Unknown
  Found in multiple species
ggctgcctttcgcatttggat

SEQ ID NO: 1675 - DNA, 21 bp, Unknown
  Found in multiple species
ggctatatctgggaagagggt

SEQ ID NO: 1676 - DNA, 21 bp, Unknown
  Found in multiple species
ggctacttgcaatgtatgaag

SEQ ID NO: 1677 - DNA, 21 bp, Unknown
  Found in multiple species
ggcggttgacagtggattgaa

SEQ ID NO: 1678 - DNA, 21 bp, Unknown
  Found in multiple species
ggcggtaggtaacataatgag

SEQ ID NO: 1679 - DNA, 21 bp, Unknown
  Found in multiple species
ggcgatgatactaccaccctt

SEQ ID NO: 1680 - DNA, 21 bp, Unknown
  Found in multiple species
ggcccttaggtttaggaaggc

SEQ ID NO: 1681 - DNA, 21 bp, Unknown
  Found in multiple species
ggccatactctcactcccaga

SEQ ID NO: 1682 - DNA, 21 bp, Unknown
  Found in multiple species
ggccagactgttggatccttt

SEQ ID NO: 1683 - DNA, 21 bp, Unknown
  Found in multiple species
ggatttatcagaatttttctg

SEQ ID NO: 1684 - DNA, 21 bp, Unknown
  Found in multiple species
ggattattcttcctttcctga

SEQ ID NO: 1685 - DNA, 21 bp, Unknown
  Found in multiple species
ggatctcagaaaaattctgat

SEQ ID NO: 1686 - DNA, 21 bp, Unknown
  Found in multiple species
ggatccaacagtctggccctt

SEQ ID NO: 1687 - DNA, 21 bp, Unknown
  Found in multiple species
ggagtgagagtatggccaaag

SEQ ID NO: 1688 - DNA, 21 bp, Unknown
  Found in multiple species
ggagtccgatggctatatctg

SEQ ID NO: 1689 - DNA, 21 bp, Unknown
  Found in multiple species
ggaggattattcttcctttcc

SEQ ID NO: 1690 - DNA, 21 bp, Unknown
  Found in multiple species
ggacgaagcaggctacttgca

SEQ ID NO: 1691 - DNA, 21 bp, Unknown
  Found in multiple species
ggaccttgatcttgagctaca

SEQ ID NO: 1692 - DNA, 21 bp, Unknown
  Found in multiple species
ggaccttcccttttttgatct

SEQ ID NO: 1693 - DNA, 21 bp, Unknown
  Found in multiple species
ggaccttagagcaaaagggtg

SEQ ID NO: 1694 - DNA, 21 bp, Unknown
  Found in multiple species
ggaccggtttctgttaggacc

SEQ ID NO: 1695 - DNA, 21 bp, Unknown
  Found in multiple species
ggaccctcttcccagatatag

SEQ ID NO: 1696 - DNA, 21 bp, Unknown
  Found in multiple species
ggaccaaagcggttgtcatga

SEQ ID NO: 1697 - DNA, 21 bp, Unknown
  Found in multiple species
ggacactttctaatattgata

SEQ ID NO: 1698 - DNA, 21 bp, Unknown
  Found in multiple species
ggaatggtaaattaaggcctg

SEQ ID NO: 1699 - DNA, 21 bp, Unknown
  Found in multiple species
ggaagagggtcctaatagttt

SEQ ID NO: 1700 - DNA, 21 bp, Unknown
  Found in multiple species
ggaacaggccttaatttacca

SEQ ID NO: 1701 - DNA, 21 bp, Unknown
  Found in multiple species
ggaaaggtctggaccttagag

SEQ ID NO: 1702 - DNA, 21 bp, Unknown
  Found in multiple species
ggaaaggaagaataatcctcc

SEQ ID NO: 1703 - DNA, 21 bp, Unknown
  Found in multiple species
ggaaagctcatgagatcaaaa

SEQ ID NO: 1704 - DNA, 21 bp, Unknown
  Found in multiple species
ggaaactattaggaccctctt

SEQ ID NO: 1705 - DNA, 21 bp, Unknown
  Found in multiple species
gctttggtcctaacagaaacc

SEQ ID NO: 1706 - DNA, 21 bp, Unknown
  Found in multiple species
gctttcctggtaagattaggg

SEQ ID NO: 1707 - DNA, 21 bp, Unknown
  Found in multiple species
gcttggcagtaaagtcaaact

SEQ ID NO: 1708 - DNA, 21 bp, Unknown
  Found in multiple species
gcttactatggcggttgacag

SEQ ID NO: 1709 - DNA, 21 bp, Unknown
  Found in multiple species
gctgctaggcttggcagtaaa

SEQ ID NO: 1710 - DNA, 21 bp, Unknown
  Found in multiple species
gctgcctttcgcatttggatt

SEQ ID NO: 1711 - DNA, 21 bp, Unknown
  Found in multiple species
gctgcatttggaaaggtctgg

SEQ ID NO: 1712 - DNA, 21 bp, Unknown
  Found in multiple species
gctctaaggtccagacctttc

SEQ ID NO: 1713 - DNA, 21 bp, Unknown
  Found in multiple species
gctcatgagatcaaaaaaggg

SEQ ID NO: 1714 - DNA, 21 bp, Unknown
  Found in multiple species
gctatatctgggaagagggtc

SEQ ID NO: 1715 - DNA, 21 bp, Unknown
  Found in multiple species
gctaggcttggcagtaaagtc

SEQ ID NO: 1716 - DNA, 21 bp, Unknown
  Found in multiple species
gctacttgcaatgtatgaagg

SEQ ID NO: 1717 - DNA, 21 bp, Unknown
  Found in multiple species
gctacattggaggtgctacaa

SEQ ID NO: 1718 - DNA, 21 bp, Unknown
  Found in multiple species
gcggttgacagtggattgaaa

SEQ ID NO: 1719 - DNA, 21 bp, Unknown
  Found in multiple species
gcgatgatactaccacccttt

SEQ ID NO: 1720 - DNA, 21 bp, Unknown
  Found in multiple species
gcgacttatcaatattagaaa

SEQ ID NO: 1721 - DNA, 21 bp, Unknown
  Found in multiple species
gcctttggccatactctcact

SEQ ID NO: 1722 - DNA, 21 bp, Unknown
  Found in multiple species
gcctttcgcatttggatttat

SEQ ID NO: 1723 - DNA, 21 bp, Unknown
  Found in multiple species
gccttcctaaacctaagggcc

SEQ ID NO: 1724 - DNA, 21 bp, Unknown
  Found in multiple species
gcctagcagcaatggcggtag

SEQ ID NO: 1725 - DNA, 21 bp, Unknown
  Found in multiple species
gcccttaggtttaggaaggcg

SEQ ID NO: 1726 - DNA, 21 bp, Unknown
  Found in multiple species
gccctaatcttaccaggaaag

SEQ ID NO: 1727 - DNA, 21 bp, Unknown
  Found in multiple species
gccattgctgctaggcttggc

SEQ ID NO: 1728 - DNA, 21 bp, Unknown
  Found in multiple species
gccatcggactccatggtagt

SEQ ID NO: 1729 - DNA, 21 bp, Unknown
  Found in multiple species
gccatactctcactcccagaa

SEQ ID NO: 1730 - DNA, 21 bp, Unknown
  Found in multiple species
gccagactgttggatccttta

SEQ ID NO: 1731 - DNA, 21 bp, Unknown
  Found in multiple species
gccaagcctagcagcaatggc

SEQ ID NO: 1732 - DNA, 21 bp, Unknown
  Found in multiple species
gcatttggatttatcagaatt

SEQ ID NO: 1733 - DNA, 21 bp, Unknown
  Found in multiple species
gcatttggaaaggtctggacc

SEQ ID NO: 1734 - DNA, 21 bp, Unknown
  Found in multiple species
gcaggctacttgcaatgtatg

SEQ ID NO: 1735 - DNA, 21 bp, Unknown
  Found in multiple species
gcagctttcatactcaacttt

SEQ ID NO: 1736 - DNA, 21 bp, Unknown
  Found in multiple species
gcagcaatggcggtaggtaac

SEQ ID NO: 1737 - DNA, 21 bp, Unknown
  Found in multiple species
gcacctccaatgtagctcaag

SEQ ID NO: 1738 - DNA, 21 bp, Unknown
  Found in multiple species
gcaccaagaccagccctaatc

SEQ ID NO: 1739 - DNA, 21 bp, Unknown
  Found in multiple species
gcaatggcggtaggtaacata

SEQ ID NO: 1740 - DNA, 21 bp, Unknown
  Found in multiple species
gcaagttcatcttcactcttt

SEQ ID NO: 1741 - DNA, 21 bp, Unknown
  Found in multiple species
gcaaaagggtggtagtatcat

SEQ ID NO: 1742 - DNA, 21 bp, Unknown
  Found in multiple species
gatttatcagaatttttctga

SEQ ID NO: 1743 - DNA, 21 bp, Unknown
  Found in multiple species
gattattcttcctttcctgaa

SEQ ID NO: 1744 - DNA, 21 bp, Unknown
  Found in multiple species
gattagggctggtcttggtgc

SEQ ID NO: 1745 - DNA, 21 bp, Unknown
  Found in multiple species
gattacggcgcacaaattctt

SEQ ID NO: 1746 - DNA, 21 bp, Unknown
  Found in multiple species
gatgttgctgcagattctctt

SEQ ID NO: 1747 - DNA, 21 bp, Unknown
  Found in multiple species
gatggaccggtttctgttagg

SEQ ID NO: 1748 - DNA, 21 bp, Unknown
  Found in multiple species
gatgatactaccacccttttg

SEQ ID NO: 1749 - DNA, 21 bp, Unknown
  Found in multiple species
gatcttgagctacattggagg

SEQ ID NO: 1750 - DNA, 21 bp, Unknown
  Found in multiple species
gatctcatgagctttcctggt

SEQ ID NO: 1751 - DNA, 21 bp, Unknown
  Found in multiple species
gatctcagaaaaattctgata

SEQ ID NO: 1752 - DNA, 21 bp, Unknown
  Found in multiple species
gatcctgtgcttactatggcg

SEQ ID NO: 1753 - DNA, 21 bp, Unknown
  Found in multiple species
gatccaacagtctggccctta

SEQ ID NO: 1754 - DNA, 21 bp, Unknown
  Found in multiple species
gatcaaaaaagggaaggtccg

SEQ ID NO: 1755 - DNA, 21 bp, Unknown
  Found in multiple species
gatatagccatcggactccat

SEQ ID NO: 1756 - DNA, 21 bp, Unknown
  Found in multiple species
gatagtttgactttactgcca

SEQ ID NO: 1757 - DNA, 21 bp, Unknown
  Found in multiple species
gatactaccacccttttgctc

SEQ ID NO: 1758 - DNA, 21 bp, Unknown
  Found in multiple species
gataagtcgctcaatggtgaa

SEQ ID NO: 1759 - DNA, 21 bp, Unknown
  Found in multiple species
gataaatccaaatgcgaaagg

SEQ ID NO: 1760 - DNA, 21 bp, Unknown
  Found in multiple species
gagtgtaccggcgatgatact

SEQ ID NO: 1761 - DNA, 21 bp, Unknown
  Found in multiple species
gagtgagagtatggccaaagg

SEQ ID NO: 1762 - DNA, 21 bp, Unknown
  Found in multiple species
gagtgaagatgaacttgcgga

SEQ ID NO: 1763 - DNA, 21 bp, Unknown
  Found in multiple species
gagtccgatggctatatctgg

SEQ ID NO: 1764 - DNA, 21 bp, Unknown
  Found in multiple species
gagtatgaaagctgcatttgg

SEQ ID NO: 1765 - DNA, 21 bp, Unknown
  Found in multiple species
gagggttggaaactattagga

SEQ ID NO: 1766 - DNA, 21 bp, Unknown
  Found in multiple species
gagggtcctaatagtttccaa

SEQ ID NO: 1767 - DNA, 21 bp, Unknown
  Found in multiple species
gaggattattcttcctttcct

SEQ ID NO: 1768 - DNA, 21 bp, Unknown
  Found in multiple species
gagctttcctggtaagattag

SEQ ID NO: 1769 - DNA, 21 bp, Unknown
  Found in multiple species
gagctacattggaggtgctac

SEQ ID NO: 1770 - DNA, 21 bp, Unknown
  Found in multiple species
gagcgacttatcaatattaga

SEQ ID NO: 1771 - DNA, 21 bp, Unknown
  Found in multiple species
gagcaaaagggtggtagtatc

SEQ ID NO: 1772 - DNA, 21 bp, Unknown
  Found in multiple species
gagattacggcgcacaaattc

SEQ ID NO: 1773 - DNA, 21 bp, Unknown
  Found in multiple species
gagatcaaaaaagggaaggtc

SEQ ID NO: 1774 - DNA, 21 bp, Unknown
  Found in multiple species
gagagtatggccaaaggcaat

SEQ ID NO: 1775 - DNA, 21 bp, Unknown
  Found in multiple species
gagacccccgccttcctaaac

SEQ ID NO: 1776 - DNA, 21 bp, Unknown
  Found in multiple species
gactttactgccaagcctagc

SEQ ID NO: 1777 - DNA, 21 bp, Unknown
  Found in multiple species
gacttatcaatattagaaagt

SEQ ID NO: 1778 - DNA, 21 bp, Unknown
  Found in multiple species
gactgttggatcctttaggaa

SEQ ID NO: 1779 - DNA, 21 bp, Unknown
  Found in multiple species
gacgaagcaggctacttgcaa

SEQ ID NO: 1780 - DNA, 21 bp, Unknown
  Found in multiple species
gacctttccaaatgcagcttt

SEQ ID NO: 1781 - DNA, 21 bp, Unknown
  Found in multiple species
gaccttgatcttgagctacat

SEQ ID NO: 1782 - DNA, 21 bp, Unknown
  Found in multiple species
gaccttcccttttttgatctc

SEQ ID NO: 1783 - DNA, 21 bp, Unknown
  Found in multiple species
gaccttagagcaaaagggtgg

SEQ ID NO: 1784 - DNA, 21 bp, Unknown
  Found in multiple species
gaccggtttctgttaggacca

SEQ ID NO: 1785 - DNA, 21 bp, Unknown
  Found in multiple species
gaccctcttcccagatatagc

SEQ ID NO: 1786 - DNA, 21 bp, Unknown
  Found in multiple species
gacccccgccttcctaaacct

SEQ ID NO: 1787 - DNA, 21 bp, Unknown
  Found in multiple species
gaccagccctaatcttaccag

SEQ ID NO: 1788 - DNA, 21 bp, Unknown
  Found in multiple species
gaccaaagcggttgtcatgac

SEQ ID NO: 1789 - DNA, 21 bp, Unknown
  Found in multiple species
gacactttctaatattgataa

SEQ ID NO: 1790 - DNA, 21 bp, Unknown
  Found in multiple species
gacaaccgctttggtcctaac

SEQ ID NO: 1791 - DNA, 21 bp, Unknown
  Found in multiple species
gaatttgtgcgccgtaatctc

SEQ ID NO: 1792 - DNA, 21 bp, Unknown
  Found in multiple species
gaatggtaaattaaggcctgt

SEQ ID NO: 1793 - DNA, 21 bp, Unknown
  Found in multiple species
gaaggaacaggccttaattta

SEQ ID NO: 1794 - DNA, 21 bp, Unknown
  Found in multiple species
gaagcaggctacttgcaatgt

SEQ ID NO: 1795 - DNA, 21 bp, Unknown
  Found in multiple species
gaagagggtcctaatagtttc

SEQ ID NO: 1796 - DNA, 21 bp, Unknown
  Found in multiple species
gaagaatttgtgcgccgtaat

SEQ ID NO: 1797 - DNA, 21 bp, Unknown
  Found in multiple species
gaacaggccttaatttaccat

SEQ ID NO: 1798 - DNA, 21 bp, Unknown
  Found in multiple species
gaaaggtctggaccttagagc

SEQ ID NO: 1799 - DNA, 21 bp, Unknown
  Found in multiple species
gaaaggaagaataatcctcca

SEQ ID NO: 1800 - DNA, 21 bp, Unknown
  Found in multiple species
gaaagctgcatttggaaaggt

SEQ ID NO: 1801 - DNA, 21 bp, Unknown
  Found in multiple species
gaaagctcatgagatcaaaaa

SEQ ID NO: 1802 - DNA, 21 bp, Unknown
  Found in multiple species
gaaactattaggaccctcttc

SEQ ID NO: 1803 - DNA, 21 bp, Unknown
  Found in multiple species
gaaaccggtccatcgggtgtt

SEQ ID NO: 1804 - DNA, 21 bp, Unknown
  Found in multiple species
gaaaaattctgataaatccaa

SEQ ID NO: 1805 - DNA, 21 bp, Unknown
  Found in multiple species
cttttttgatctcatgagctt

SEQ ID NO: 1806 - DNA, 21 bp, Unknown
  Found in multiple species
cttttgctctaaggtccagac

SEQ ID NO: 1807 - DNA, 21 bp, Unknown
  Found in multiple species
ctttggtcctaacagaaaccg

SEQ ID NO: 1808 - DNA, 21 bp, Unknown
  Found in multiple species
ctttggccatactctcactcc

SEQ ID NO: 1809 - DNA, 21 bp, Unknown
  Found in multiple species
ctttctaatattgataagtcg

SEQ ID NO: 1810 - DNA, 21 bp, Unknown
  Found in multiple species
ctttcgcatttggatttatca

SEQ ID NO: 1811 - DNA, 21 bp, Unknown
  Found in multiple species
ctttcctggtaagattagggc

SEQ ID NO: 1812 - DNA, 21 bp, Unknown
  Found in multiple species
ctttcctaaaggatccaacag

SEQ ID NO: 1813 - DNA, 21 bp, Unknown
  Found in multiple species
ctttccaaatgcagctttcat

SEQ ID NO: 1814 - DNA, 21 bp, Unknown
  Found in multiple species
ctttcaatccactgtcaaccg

SEQ ID NO: 1815 - DNA, 21 bp, Unknown
  Found in multiple species
ctttactgccaagcctagcag

SEQ ID NO: 1816 - DNA, 21 bp, Unknown
  Found in multiple species
cttggcagtaaagtcaaacta

SEQ ID NO: 1817 - DNA, 21 bp, Unknown
  Found in multiple species
cttgatcttgagctacattgg

SEQ ID NO: 1818 - DNA, 21 bp, Unknown
  Found in multiple species
cttgagctacattggaggtgc

SEQ ID NO: 1819 - DNA, 21 bp, Unknown
  Found in multiple species
cttcctaaacctaagggccag

SEQ ID NO: 1820 - DNA, 21 bp, Unknown
  Found in multiple species
cttcccttttttgatctcatg

SEQ ID NO: 1821 - DNA, 21 bp, Unknown
  Found in multiple species
cttcatacattgcaagtagcc

SEQ ID NO: 1822 - DNA, 21 bp, Unknown
  Found in multiple species
cttatcaatattagaaagtgt

SEQ ID NO: 1823 - DNA, 21 bp, Unknown
  Found in multiple species
cttaggtttaggaaggcgggg

SEQ ID NO: 1824 - DNA, 21 bp, Unknown
  Found in multiple species
cttagagcaaaagggtggtag

SEQ ID NO: 1825 - DNA, 21 bp, Unknown
  Found in multiple species
cttactatggcggttgacagt

SEQ ID NO: 1826 - DNA, 21 bp, Unknown
  Found in multiple species
cttaccaggaaagctcatgag

SEQ ID NO: 1827 - DNA, 21 bp, Unknown
  Found in multiple species
ctgttggatcctttaggaaag

SEQ ID NO: 1828 - DNA, 21 bp, Unknown
  Found in multiple species
ctgttaggaccaaagcggttg

SEQ ID NO: 1829 - DNA, 21 bp, Unknown
  Found in multiple species
ctgtgcttactatggcggttg

SEQ ID NO: 1830 - DNA, 21 bp, Unknown
  Found in multiple species
ctgtcaaccgccatagtaagc

SEQ ID NO: 1831 - DNA, 21 bp, Unknown
  Found in multiple species
ctggtaagattagggctggtc

SEQ ID NO: 1832 - DNA, 21 bp, Unknown
  Found in multiple species
ctgggagtgagagtatggcca

SEQ ID NO: 1833 - DNA, 21 bp, Unknown
  Found in multiple species
ctgggaagagggtcctaatag

SEQ ID NO: 1834 - DNA, 21 bp, Unknown
  Found in multiple species
ctggcccttaggtttaggaag

SEQ ID NO: 1835 - DNA, 21 bp, Unknown
  Found in multiple species
ctggaccttagagcaaaaggg

SEQ ID NO: 1836 - DNA, 21 bp, Unknown
  Found in multiple species
ctgctaggcttggcagtaaag

SEQ ID NO: 1837 - DNA, 21 bp, Unknown
  Found in multiple species
ctgcctttcgcatttggattt

SEQ ID NO: 1838 - DNA, 21 bp, Unknown
  Found in multiple species
ctgccaagcctagcagcaatg

SEQ ID NO: 1839 - DNA, 21 bp, Unknown
  Found in multiple species
ctgcatttggaaaggtctgga

SEQ ID NO: 1840 - DNA, 21 bp, Unknown
  Found in multiple species
ctgataaatccaaatgcgaaa

SEQ ID NO: 1841 - DNA, 21 bp, Unknown
  Found in multiple species
ctctaaggtccagacctttcc

SEQ ID NO: 1842 - DNA, 21 bp, Unknown
  Found in multiple species
ctcgagacccccgccttccta

SEQ ID NO: 1843 - DNA, 21 bp, Unknown
  Found in multiple species
ctccaatgtagctcaagatca

SEQ ID NO: 1844 - DNA, 21 bp, Unknown
  Found in multiple species
ctcattatgttacctaccgcc

SEQ ID NO: 1845 - DNA, 21 bp, Unknown
  Found in multiple species
ctcatgagctttcctggtaag

SEQ ID NO: 1846 - DNA, 21 bp, Unknown
  Found in multiple species
ctcatgagatcaaaaaaggga

SEQ ID NO: 1847 - DNA, 21 bp, Unknown
  Found in multiple species
ctcagaaaaattctgataaat

SEQ ID NO: 1848 - DNA, 21 bp, Unknown
  Found in multiple species
ctattcaggaaaggaagaata

SEQ ID NO: 1849 - DNA, 21 bp, Unknown
  Found in multiple species
ctattaggaccctcttcccag

SEQ ID NO: 1850 - DNA, 21 bp, Unknown
  Found in multiple species
ctatggcggttgacagtggat

SEQ ID NO: 1851 - DNA, 21 bp, Unknown
  Found in multiple species
ctatatctgggaagagggtcc

SEQ ID NO: 1852 - DNA, 21 bp, Unknown
  Found in multiple species
ctaggcttggcagtaaagtca

SEQ ID NO: 1853 - DNA, 21 bp, Unknown
  Found in multiple species
ctagcagcaatggcggtaggt

SEQ ID NO: 1854 - DNA, 21 bp, Unknown
  Found in multiple species
ctacggaccttcccttttttg

SEQ ID NO: 1855 - DNA, 21 bp, Unknown
  Found in multiple species
ctaccgccattgctgctaggc

SEQ ID NO: 1856 - DNA, 21 bp, Unknown
  Found in multiple species
ctaccatggagtccgatggct

SEQ ID NO: 1857 - DNA, 21 bp, Unknown
  Found in multiple species
ctaccacccttttgctctaag

SEQ ID NO: 1858 - DNA, 21 bp, Unknown
  Found in multiple species
ctaatcttaccaggaaagctc

SEQ ID NO: 1859 - DNA, 21 bp, Unknown
  Found in multiple species
ctaatattgataagtcgctca

SEQ ID NO: 1860 - DNA, 21 bp, Unknown
  Found in multiple species
ctaaggtccagacctttccaa

SEQ ID NO: 1861 - DNA, 21 bp, Unknown
  Found in multiple species
ctaagggccagactgttggat

SEQ ID NO: 1862 - DNA, 21 bp, Unknown
  Found in multiple species
ctaacagaaaccggtccatcg

SEQ ID NO: 1863 - DNA, 21 bp, Unknown
  Found in multiple species
ctaaaggatccaacagtctgg

SEQ ID NO: 1864 - DNA, 21 bp, Unknown
  Found in multiple species
ctaaacctaagggccagactg

SEQ ID NO: 1865 - DNA, 21 bp, Unknown
  Found in multiple species
cggtttctgttaggaccaaag

SEQ ID NO: 1866 - DNA, 21 bp, Unknown
  Found in multiple species
cggttgacagtggattgaaag

SEQ ID NO: 1867 - DNA, 21 bp, Unknown
  Found in multiple species
cggtccatcgggtgtttgata

SEQ ID NO: 1868 - DNA, 21 bp, Unknown
  Found in multiple species
cggctgcctttcgcatttgga

SEQ ID NO: 1869 - DNA, 21 bp, Unknown
  Found in multiple species
cggcgatgatactaccaccct

SEQ ID NO: 1870 - DNA, 21 bp, Unknown
  Found in multiple species
cggaccttcccttttttgatc

SEQ ID NO: 1871 - DNA, 21 bp, Unknown
  Found in multiple species
cgctttggtcctaacagaaac

SEQ ID NO: 1872 - DNA, 21 bp, Unknown
  Found in multiple species
cgccttcctaaacctaagggc

SEQ ID NO: 1873 - DNA, 21 bp, Unknown
  Found in multiple species
cgccattgctgctaggcttgg

SEQ ID NO: 1874 - DNA, 21 bp, Unknown
  Found in multiple species
cgccatagtaagcacaggatc

SEQ ID NO: 1875 - DNA, 21 bp, Unknown
  Found in multiple species
cgcatttggatttatcagaat

SEQ ID NO: 1876 - DNA, 21 bp, Unknown
  Found in multiple species
cgcaagttcatcttcactctt

SEQ ID NO: 1877 - DNA, 21 bp, Unknown
  Found in multiple species
cgatggaccggtttctgttag

SEQ ID NO: 1878 - DNA, 21 bp, Unknown
  Found in multiple species
cgatgatactaccaccctttt

SEQ ID NO: 1879 - DNA, 21 bp, Unknown
  Found in multiple species
cgagattacggcgcacaaatt

SEQ ID NO: 1880 - DNA, 21 bp, Unknown
  Found in multiple species
cgagacccccgccttcctaaa

SEQ ID NO: 1881 - DNA, 21 bp, Unknown
  Found in multiple species
cgacttatcaatattagaaag

SEQ ID NO: 1882 - DNA, 21 bp, Unknown
  Found in multiple species
cgaagcaggctacttgcaatg

SEQ ID NO: 1883 - DNA, 21 bp, Unknown
  Found in multiple species
ccttttttgatctcatgagct

SEQ ID NO: 1884 - DNA, 21 bp, Unknown
  Found in multiple species
ccttttgctctaaggtccaga

SEQ ID NO: 1885 - DNA, 21 bp, Unknown
  Found in multiple species
cctttggccatactctcactc

SEQ ID NO: 1886 - DNA, 21 bp, Unknown
  Found in multiple species
cctttcgcatttggatttatc

SEQ ID NO: 1887 - DNA, 21 bp, Unknown
  Found in multiple species
cctttcctaaaggatccaaca

SEQ ID NO: 1888 - DNA, 21 bp, Unknown
  Found in multiple species
cctttccaaatgcagctttca

SEQ ID NO: 1889 - DNA, 21 bp, Unknown
  Found in multiple species
ccttgatcttgagctacattg

SEQ ID NO: 1890 - DNA, 21 bp, Unknown
  Found in multiple species
ccttcctaaacctaagggcca

SEQ ID NO: 1891 - DNA, 21 bp, Unknown
  Found in multiple species
ccttcccttttttgatctcat

SEQ ID NO: 1892 - DNA, 21 bp, Unknown
  Found in multiple species
ccttcatacattgcaagtagc

SEQ ID NO: 1893 - DNA, 21 bp, Unknown
  Found in multiple species
ccttaggtttaggaaggcggg

SEQ ID NO: 1894 - DNA, 21 bp, Unknown
  Found in multiple species
ccttagagcaaaagggtggta

SEQ ID NO: 1895 - DNA, 21 bp, Unknown
  Found in multiple species
cctgtgcttactatggcggtt

SEQ ID NO: 1896 - DNA, 21 bp, Unknown
  Found in multiple species
cctggtaagattagggctggt

SEQ ID NO: 1897 - DNA, 21 bp, Unknown
  Found in multiple species
cctcgagacccccgccttcct

SEQ ID NO: 1898 - DNA, 21 bp, Unknown
  Found in multiple species
cctccaatgtagctcaagatc

SEQ ID NO: 1899 - DNA, 21 bp, Unknown
  Found in multiple species
cctagcagcaatggcggtagg

SEQ ID NO: 1900 - DNA, 21 bp, Unknown
  Found in multiple species
cctacggaccttccctttttt

SEQ ID NO: 1901 - DNA, 21 bp, Unknown
  Found in multiple species
cctaccgccattgctgctagg

SEQ ID NO: 1902 - DNA, 21 bp, Unknown
  Found in multiple species
cctaatcttaccaggaaagct

SEQ ID NO: 1903 - DNA, 21 bp, Unknown
  Found in multiple species
cctaagggccagactgttgga

SEQ ID NO: 1904 - DNA, 21 bp, Unknown
  Found in multiple species
cctaacagaaaccggtccatc

SEQ ID NO: 1905 - DNA, 21 bp, Unknown
  Found in multiple species
cctaaaggatccaacagtctg

SEQ ID NO: 1906 - DNA, 21 bp, Unknown
  Found in multiple species
cctaaacctaagggccagact

SEQ ID NO: 1907 - DNA, 21 bp, Unknown
  Found in multiple species
ccggtttctgttaggaccaaa

SEQ ID NO: 1908 - DNA, 21 bp, Unknown
  Found in multiple species
ccggtccatcgggtgtttgat

SEQ ID NO: 1909 - DNA, 21 bp, Unknown
  Found in multiple species
ccggcgatgatactaccaccc

SEQ ID NO: 1910 - DNA, 21 bp, Unknown
  Found in multiple species
ccgctttggtcctaacagaaa

SEQ ID NO: 1911 - DNA, 21 bp, Unknown
  Found in multiple species
ccgccttcctaaacctaaggg

SEQ ID NO: 1912 - DNA, 21 bp, Unknown
  Found in multiple species
ccgccattgctgctaggcttg

SEQ ID NO: 1913 - DNA, 21 bp, Unknown
  Found in multiple species
ccgccatagtaagcacaggat

SEQ ID NO: 1914 - DNA, 21 bp, Unknown
  Found in multiple species
ccgcaagttcatcttcactct

SEQ ID NO: 1915 - DNA, 21 bp, Unknown
  Found in multiple species
ccgatggaccggtttctgtta

SEQ ID NO: 1916 - DNA, 21 bp, Unknown
  Found in multiple species
ccgagattacggcgcacaaat

SEQ ID NO: 1917 - DNA, 21 bp, Unknown
  Found in multiple species
cccttttttgatctcatgagc

SEQ ID NO: 1918 - DNA, 21 bp, Unknown
  Found in multiple species
cccttttgctctaaggtccag

SEQ ID NO: 1919 - DNA, 21 bp, Unknown
  Found in multiple species
cccttaggtttaggaaggcgg

SEQ ID NO: 1920 - DNA, 21 bp, Unknown
  Found in multiple species
ccctaatcttaccaggaaagc

SEQ ID NO: 1921 - DNA, 21 bp, Unknown
  Found in multiple species
cccgccttcctaaacctaagg

SEQ ID NO: 1922 - DNA, 21 bp, Unknown
  Found in multiple species
cccgatggaccggtttctgtt

SEQ ID NO: 1923 - DNA, 21 bp, Unknown
  Found in multiple species
ccccgccttcctaaacctaag

SEQ ID NO: 1924 - DNA, 21 bp, Unknown
  Found in multiple species
cccccgccttcctaaacctaa

SEQ ID NO: 1925 - DNA, 21 bp, Unknown
  Found in multiple species
cccagatatagccatcggact

SEQ ID NO: 1926 - DNA, 21 bp, Unknown
  Found in multiple species
ccattgctgctaggcttggca

SEQ ID NO: 1927 - DNA, 21 bp, Unknown
  Found in multiple species
ccattgagcgacttatcaata

SEQ ID NO: 1928 - DNA, 21 bp, Unknown
  Found in multiple species
ccatggagtccgatggctata

SEQ ID NO: 1929 - DNA, 21 bp, Unknown
  Found in multiple species
ccatactctcactcccagaac

SEQ ID NO: 1930 - DNA, 21 bp, Unknown
  Found in multiple species
ccagtcgcagcagtgtccctt

SEQ ID NO: 1931 - DNA, 21 bp, Unknown
  Found in multiple species
ccaggaaagctcatgagatca

SEQ ID NO: 1932 - DNA, 21 bp, Unknown
  Found in multiple species
ccagccctaatcttaccagga

SEQ ID NO: 1933 - DNA, 21 bp, Unknown
  Found in multiple species
ccagatatagccatcggactc

SEQ ID NO: 1934 - DNA, 21 bp, Unknown
  Found in multiple species
ccagactgttggatcctttag

SEQ ID NO: 1935 - DNA, 21 bp, Unknown
  Found in multiple species
ccagacctttccaaatgcagc

SEQ ID NO: 1936 - DNA, 21 bp, Unknown
  Found in multiple species
ccactgtcaaccgccatagta

SEQ ID NO: 1937 - DNA, 21 bp, Unknown
  Found in multiple species
ccacccttttgctctaaggtc

SEQ ID NO: 1938 - DNA, 21 bp, Unknown
  Found in multiple species
ccaatgtagctcaagatcaag

SEQ ID NO: 1939 - DNA, 21 bp, Unknown
  Found in multiple species
ccaagcctagcagcaatggcg

SEQ ID NO: 1940 - DNA, 21 bp, Unknown
  Found in multiple species
ccaagaccagccctaatctta

SEQ ID NO: 1941 - DNA, 21 bp, Unknown
  Found in multiple species
ccaacagtctggcccttaggt

SEQ ID NO: 1942 - DNA, 21 bp, Unknown
  Found in multiple species
ccaaatgcagctttcatactc

SEQ ID NO: 1943 - DNA, 21 bp, Unknown
  Found in multiple species
ccaaagcggttgtcatgactg

SEQ ID NO: 1944 - DNA, 21 bp, Unknown
  Found in multiple species
catttggatttatcagaattt

SEQ ID NO: 1945 - DNA, 21 bp, Unknown
  Found in multiple species
catttggaaaggtctggacct

SEQ ID NO: 1946 - DNA, 21 bp, Unknown
  Found in multiple species
cattgctgctaggcttggcag

SEQ ID NO: 1947 - DNA, 21 bp, Unknown
  Found in multiple species
cattgcaagtagcctgcttcg

SEQ ID NO: 1948 - DNA, 21 bp, Unknown
  Found in multiple species
cattgagcgacttatcaatat

SEQ ID NO: 1949 - DNA, 21 bp, Unknown
  Found in multiple species
cattatgttacctaccgccat

SEQ ID NO: 1950 - DNA, 21 bp, Unknown
  Found in multiple species
catggagtccgatggctatat

SEQ ID NO: 1951 - DNA, 21 bp, Unknown
  Found in multiple species
catgagctttcctggtaagat

SEQ ID NO: 1952 - DNA, 21 bp, Unknown
  Found in multiple species
catgagatcaaaaaagggaag

SEQ ID NO: 1953 - DNA, 21 bp, Unknown
  Found in multiple species
catgacaaccgctttggtcct

SEQ ID NO: 1954 - DNA, 21 bp, Unknown
  Found in multiple species
catcttcactcttttgtaata

SEQ ID NO: 1955 - DNA, 21 bp, Unknown
  Found in multiple species
catacattgcaagtagcctgc

SEQ ID NO: 1956 - DNA, 21 bp, Unknown
  Found in multiple species
cagtctggcccttaggtttag

SEQ ID NO: 1957 - DNA, 21 bp, Unknown
  Found in multiple species
cagtcatgacaaccgctttgg

SEQ ID NO: 1958 - DNA, 21 bp, Unknown
  Found in multiple species
caggctacttgcaatgtatga

SEQ ID NO: 1959 - DNA, 21 bp, Unknown
  Found in multiple species
caggccttaatttaccattcc

SEQ ID NO: 1960 - DNA, 21 bp, Unknown
  Found in multiple species
caggaaaggaagaataatcct

SEQ ID NO: 1961 - DNA, 21 bp, Unknown
  Found in multiple species
caggaaagctcatgagatcaa

SEQ ID NO: 1962 - DNA, 21 bp, Unknown
  Found in multiple species
cagctttcatactcaactttg

SEQ ID NO: 1963 - DNA, 21 bp, Unknown
  Found in multiple species
cagccctaatcttaccaggaa

SEQ ID NO: 1964 - DNA, 21 bp, Unknown
  Found in multiple species
cagcaatggcggtaggtaaca

SEQ ID NO: 1965 - DNA, 21 bp, Unknown
  Found in multiple species
cagatatagccatcggactcc

SEQ ID NO: 1966 - DNA, 21 bp, Unknown
  Found in multiple species
cagactgttggatcctttagg

SEQ ID NO: 1967 - DNA, 21 bp, Unknown
  Found in multiple species
cagacctttccaaatgcagct

SEQ ID NO: 1968 - DNA, 21 bp, Unknown
  Found in multiple species
cagaatttttctgagatcctt

SEQ ID NO: 1969 - DNA, 21 bp, Unknown
  Found in multiple species
cagaaaccggtccatcgggtg

SEQ ID NO: 1970 - DNA, 21 bp, Unknown
  Found in multiple species
cagaaaaattctgataaatcc

SEQ ID NO: 1971 - DNA, 21 bp, Unknown
  Found in multiple species
cactttctaatattgataagt

SEQ ID NO: 1972 - DNA, 21 bp, Unknown
  Found in multiple species
cactgtcaaccgccatagtaa

SEQ ID NO: 1973 - DNA, 21 bp, Unknown
  Found in multiple species
cacctccaatgtagctcaaga

SEQ ID NO: 1974 - DNA, 21 bp, Unknown
  Found in multiple species
cacccttttgctctaaggtcc

SEQ ID NO: 1975 - DNA, 21 bp, Unknown
  Found in multiple species
cacccgatggaccggtttctg

SEQ ID NO: 1976 - DNA, 21 bp, Unknown
  Found in multiple species
caccattgagcgacttatcaa

SEQ ID NO: 1977 - DNA, 21 bp, Unknown
  Found in multiple species
caccaagaccagccctaatct

SEQ ID NO: 1978 - DNA, 21 bp, Unknown
  Found in multiple species
caatgtagctcaagatcaagg

SEQ ID NO: 1979 - DNA, 21 bp, Unknown
  Found in multiple species
caatggcggtaggtaacataa

SEQ ID NO: 1980 - DNA, 21 bp, Unknown
  Found in multiple species
caatccactgtcaaccgccat

SEQ ID NO: 1981 - DNA, 21 bp, Unknown
  Found in multiple species
caagttcatcttcactctttt

SEQ ID NO: 1982 - DNA, 21 bp, Unknown
  Found in multiple species
caagcctagcagcaatggcgg

SEQ ID NO: 1983 - DNA, 21 bp, Unknown
  Found in multiple species
caagaccagccctaatcttac

SEQ ID NO: 1984 - DNA, 21 bp, Unknown
  Found in multiple species
caaccgctttggtcctaacag

SEQ ID NO: 1985 - DNA, 21 bp, Unknown
  Found in multiple species
caaccgccatagtaagcacag

SEQ ID NO: 1986 - DNA, 21 bp, Unknown
  Found in multiple species
caacagtctggcccttaggtt

SEQ ID NO: 1987 - DNA, 21 bp, Unknown
  Found in multiple species
caaatgcagctttcatactca

SEQ ID NO: 1988 - DNA, 21 bp, Unknown
  Found in multiple species
caaagttgagtatgaaagctg

SEQ ID NO: 1989 - DNA, 21 bp, Unknown
  Found in multiple species
caaagcggttgtcatgactgt

SEQ ID NO: 1990 - DNA, 21 bp, Unknown
  Found in multiple species
caaacacccgatggaccggtt

SEQ ID NO: 1991 - DNA, 21 bp, Unknown
  Found in multiple species
caaaagggtggtagtatcatc

SEQ ID NO: 1992 - DNA, 21 bp, Unknown
  Found in multiple species
caaaagagtgaagatgaactt

SEQ ID NO: 1993 - DNA, 21 bp, Unknown
  Found in multiple species
caaaaaagggaaggtccgtag

SEQ ID NO: 1994 - DNA, 21 bp, Unknown
  Found in multiple species
atttgtgcgccgtaatctcgg

SEQ ID NO: 1995 - DNA, 21 bp, Unknown
  Found in multiple species
atttggatttatcagaatttt

SEQ ID NO: 1996 - DNA, 21 bp, Unknown
  Found in multiple species
atttggaaaggtctggacctt

SEQ ID NO: 1997 - DNA, 21 bp, Unknown
  Found in multiple species
atttatcagaatttttctgag

SEQ ID NO: 1998 - DNA, 21 bp, Unknown
  Found in multiple species
attgctgctaggcttggcagt

SEQ ID NO: 1999 - DNA, 21 bp, Unknown
  Found in multiple species
attgcctttggccatactctc

SEQ ID NO: 2000 - DNA, 21 bp, Unknown
  Found in multiple species
attgcaagtagcctgcttcgt

SEQ ID NO: 2001 - DNA, 21 bp, Unknown
  Found in multiple species
attgataagtcgctcaatggt

SEQ ID NO: 2002 - DNA, 21 bp, Unknown
  Found in multiple species
attgagcgacttatcaatatt

SEQ ID NO: 2003 - DNA, 21 bp, Unknown
  Found in multiple species
attctgataaatccaaatgcg

SEQ ID NO: 2004 - DNA, 21 bp, Unknown
  Found in multiple species
attcaggaaaggaagaataat

SEQ ID NO: 2005 - DNA, 21 bp, Unknown
  Found in multiple species
attcaccattgagcgacttat

SEQ ID NO: 2006 - DNA, 21 bp, Unknown
  Found in multiple species
attattcttcctttcctgaat

SEQ ID NO: 2007 - DNA, 21 bp, Unknown
  Found in multiple species
attatgttacctaccgccatt

SEQ ID NO: 2008 - DNA, 21 bp, Unknown
  Found in multiple species
attaggaccctcttcccagat

SEQ ID NO: 2009 - DNA, 21 bp, Unknown
  Found in multiple species
attacggcgcacaaattcttc

SEQ ID NO: 2010 - DNA, 21 bp, Unknown
  Found in multiple species
attacaaaagagtgaagatga

SEQ ID NO: 2011 - DNA, 21 bp, Unknown
  Found in multiple species
atgttacctaccgccattgct

SEQ ID NO: 2012 - DNA, 21 bp, Unknown
  Found in multiple species
atgtagctcaagatcaaggtc

SEQ ID NO: 2013 - DNA, 21 bp, Unknown
  Found in multiple species
atggtaaattaaggcctgttc

SEQ ID NO: 2014 - DNA, 21 bp, Unknown
  Found in multiple species
atggcggttgacagtggattg

SEQ ID NO: 2015 - DNA, 21 bp, Unknown
  Found in multiple species
atggcggtaggtaacataatg

SEQ ID NO: 2016 - DNA, 21 bp, Unknown
  Found in multiple species
atggagtccgatggctatatc

SEQ ID NO: 2017 - DNA, 21 bp, Unknown
  Found in multiple species
atggaccggtttctgttagga

SEQ ID NO: 2018 - DNA, 21 bp, Unknown
  Found in multiple species
atgcagctttcatactcaact

SEQ ID NO: 2019 - DNA, 21 bp, Unknown
  Found in multiple species
atgatactaccacccttttgc

SEQ ID NO: 2020 - DNA, 21 bp, Unknown
  Found in multiple species
atgagctttcctggtaagatt

SEQ ID NO: 2021 - DNA, 21 bp, Unknown
  Found in multiple species
atgagatcaaaaaagggaagg

SEQ ID NO: 2022 - DNA, 21 bp, Unknown
  Found in multiple species
atgacaaccgctttggtccta

SEQ ID NO: 2023 - DNA, 21 bp, Unknown
  Found in multiple species
atgaaagctgcatttggaaag

SEQ ID NO: 2024 - DNA, 21 bp, Unknown
  Found in multiple species
atcttgagctacattggaggt

SEQ ID NO: 2025 - DNA, 21 bp, Unknown
  Found in multiple species
atcttcactcttttgtaatat

SEQ ID NO: 2026 - DNA, 21 bp, Unknown
  Found in multiple species
atcttaccaggaaagctcatg

SEQ ID NO: 2027 - DNA, 21 bp, Unknown
  Found in multiple species
atctgggaagagggtcctaat

SEQ ID NO: 2028 - DNA, 21 bp, Unknown
  Found in multiple species
atctcatgagctttcctggta

SEQ ID NO: 2029 - DNA, 21 bp, Unknown
  Found in multiple species
atctcagaaaaattctgataa

SEQ ID NO: 2030 - DNA, 21 bp, Unknown
  Found in multiple species
atcctgtgcttactatggcgg

SEQ ID NO: 2031 - DNA, 21 bp, Unknown
  Found in multiple species
atccactgtcaaccgccatag

SEQ ID NO: 2032 - DNA, 21 bp, Unknown
  Found in multiple species
atccaacagtctggcccttag

SEQ ID NO: 2033 - DNA, 21 bp, Unknown
  Found in multiple species
atccaaatgcgaaaggcagcc

SEQ ID NO: 2034 - DNA, 21 bp, Unknown
  Found in multiple species
atcatcgccggtacactcaaa

SEQ ID NO: 2035 - DNA, 21 bp, Unknown
  Found in multiple species
atcagaatttttctgagatcc

SEQ ID NO: 2036 - DNA, 21 bp, Unknown
  Found in multiple species
atcaatattagaaagtgtcca

SEQ ID NO: 2037 - DNA, 21 bp, Unknown
  Found in multiple species
atcaaacacccgatggaccgg

SEQ ID NO: 2038 - DNA, 21 bp, Unknown
  Found in multiple species
atcaaaaaagggaaggtccgt

SEQ ID NO: 2039 - DNA, 21 bp, Unknown
  Found in multiple species
atattgataagtcgctcaatg

SEQ ID NO: 2040 - DNA, 21 bp, Unknown
  Found in multiple species
atattacaaaagagtgaagat

SEQ ID NO: 2041 - DNA, 21 bp, Unknown
  Found in multiple species
atatctgggaagagggtccta

SEQ ID NO: 2042 - DNA, 21 bp, Unknown
  Found in multiple species
atatagccatcggactccatg

SEQ ID NO: 2043 - DNA, 21 bp, Unknown
  Found in multiple species
atagtttgactttactgccaa

SEQ ID NO: 2044 - DNA, 21 bp, Unknown
  Found in multiple species
atagccatcggactccatggt

SEQ ID NO: 2045 - DNA, 21 bp, Unknown
  Found in multiple species
atactaccacccttttgctct

SEQ ID NO: 2046 - DNA, 21 bp, Unknown
  Found in multiple species
atacattgcaagtagcctgct

SEQ ID NO: 2047 - DNA, 21 bp, Unknown
  Found in multiple species
ataagtcgctcaatggtgaat

SEQ ID NO: 2048 - DNA, 21 bp, Unknown
  Found in multiple species
ataaatccaaatgcgaaaggc

SEQ ID NO: 2049 - DNA, 21 bp, Unknown
  Found in multiple species
agtttgactttactgccaagc

SEQ ID NO: 2050 - DNA, 21 bp, Unknown
  Found in multiple species
agttgagtatgaaagctgcat

SEQ ID NO: 2051 - DNA, 21 bp, Unknown
  Found in multiple species
agttcatcttcactcttttgt

SEQ ID NO: 2052 - DNA, 21 bp, Unknown
  Found in multiple species
agtgtaccggcgatgatacta

SEQ ID NO: 2053 - DNA, 21 bp, Unknown
  Found in multiple species
agtgagagtatggccaaaggc

SEQ ID NO: 2054 - DNA, 21 bp, Unknown
  Found in multiple species
agtctggcccttaggtttagg

SEQ ID NO: 2055 - DNA, 21 bp, Unknown
  Found in multiple species
agtcgctcaatggtgaataca

SEQ ID NO: 2056 - DNA, 21 bp, Unknown
  Found in multiple species
agtccgatggctatatctggg

SEQ ID NO: 2057 - DNA, 21 bp, Unknown
  Found in multiple species
agtcatgacaaccgctttggt

SEQ ID NO: 2058 - DNA, 21 bp, Unknown
  Found in multiple species
agtatgaaagctgcatttgga

SEQ ID NO: 2059 - DNA, 21 bp, Unknown
  Found in multiple species
agtatcatcgccggtacactc

SEQ ID NO: 2060 - DNA, 21 bp, Unknown
  Found in multiple species
aggtttaggaaggcgggggtc

SEQ ID NO: 2061 - DNA, 21 bp, Unknown
  Found in multiple species
aggtctggaccttagagcaaa

SEQ ID NO: 2062 - DNA, 21 bp, Unknown
  Found in multiple species
aggtccagacctttccaaatg

SEQ ID NO: 2063 - DNA, 21 bp, Unknown
  Found in multiple species
agggttggaaactattaggac

SEQ ID NO: 2064 - DNA, 21 bp, Unknown
  Found in multiple species
agggtggtagtatcatcgccg

SEQ ID NO: 2065 - DNA, 21 bp, Unknown
  Found in multiple species
agggtcctaatagtttccaac

SEQ ID NO: 2066 - DNA, 21 bp, Unknown
  Found in multiple species
agggccagactgttggatcct

SEQ ID NO: 2067 - DNA, 21 bp, Unknown
  Found in multiple species
aggcttggcagtaaagtcaaa

SEQ ID NO: 2068 - DNA, 21 bp, Unknown
  Found in multiple species
aggctacttgcaatgtatgaa

SEQ ID NO: 2069 - DNA, 21 bp, Unknown
  Found in multiple species
aggccttaatttaccattcca

SEQ ID NO: 2070 - DNA, 21 bp, Unknown
  Found in multiple species
aggattattcttcctttcctg

SEQ ID NO: 2071 - DNA, 21 bp, Unknown
  Found in multiple species
aggatctcagaaaaattctga

SEQ ID NO: 2072 - DNA, 21 bp, Unknown
  Found in multiple species
aggatccaacagtctggccct

SEQ ID NO: 2073 - DNA, 21 bp, Unknown
  Found in multiple species
aggaccttgatcttgagctac

SEQ ID NO: 2074 - DNA, 21 bp, Unknown
  Found in multiple species
aggaccctcttcccagatata

SEQ ID NO: 2075 - DNA, 21 bp, Unknown
  Found in multiple species
aggaccaaagcggttgtcatg

SEQ ID NO: 2076 - DNA, 21 bp, Unknown
  Found in multiple species
aggaaggcgggggtctcgagg

SEQ ID NO: 2077 - DNA, 21 bp, Unknown
  Found in multiple species
aggaacaggccttaatttacc

SEQ ID NO: 2078 - DNA, 21 bp, Unknown
  Found in multiple species
aggaaaggaagaataatcctc

SEQ ID NO: 2079 - DNA, 21 bp, Unknown
  Found in multiple species
aggaaagctcatgagatcaaa

SEQ ID NO: 2080 - DNA, 21 bp, Unknown
  Found in multiple species
agctttcctggtaagattagg

SEQ ID NO: 2081 - DNA, 21 bp, Unknown
  Found in multiple species
agctgcatttggaaaggtctg

SEQ ID NO: 2082 - DNA, 21 bp, Unknown
  Found in multiple species
agctcatgagatcaaaaaagg

SEQ ID NO: 2083 - DNA, 21 bp, Unknown
  Found in multiple species
agctacattggaggtgctaca

SEQ ID NO: 2084 - DNA, 21 bp, Unknown
  Found in multiple species
agcgacttatcaatattagaa

SEQ ID NO: 2085 - DNA, 21 bp, Unknown
  Found in multiple species
agcctagcagcaatggcggta

SEQ ID NO: 2086 - DNA, 21 bp, Unknown
  Found in multiple species
agccctaatcttaccaggaaa

SEQ ID NO: 2087 - DNA, 21 bp, Unknown
  Found in multiple species
agccatcggactccatggtag

SEQ ID NO: 2088 - DNA, 21 bp, Unknown
  Found in multiple species
agcaggctacttgcaatgtat

SEQ ID NO: 2089 - DNA, 21 bp, Unknown
  Found in multiple species
agcagcaatggcggtaggtaa

SEQ ID NO: 2090 - DNA, 21 bp, Unknown
  Found in multiple species
agcacctccaatgtagctcaa

SEQ ID NO: 2091 - DNA, 21 bp, Unknown
  Found in multiple species
agcaatggcggtaggtaacat

SEQ ID NO: 2092 - DNA, 21 bp, Unknown
  Found in multiple species
agcaaaagggtggtagtatca

SEQ ID NO: 2093 - DNA, 21 bp, Unknown
  Found in multiple species
agattagggctggtcttggtg

SEQ ID NO: 2094 - DNA, 21 bp, Unknown
  Found in multiple species
agattacggcgcacaaattct

SEQ ID NO: 2095 - DNA, 21 bp, Unknown
  Found in multiple species
agatcaaaaaagggaaggtcc

SEQ ID NO: 2096 - DNA, 21 bp, Unknown
  Found in multiple species
agatatagccatcggactcca

SEQ ID NO: 2097 - DNA, 21 bp, Unknown
  Found in multiple species
agagtgaagatgaacttgcgg

SEQ ID NO: 2098 - DNA, 21 bp, Unknown
  Found in multiple species
agagggtcctaatagtttcca

SEQ ID NO: 2099 - DNA, 21 bp, Unknown
  Found in multiple species
agagcaaaagggtggtagtat

SEQ ID NO: 2100 - DNA, 21 bp, Unknown
  Found in multiple species
agactgttggatcctttagga

SEQ ID NO: 2101 - DNA, 21 bp, Unknown
  Found in multiple species
agacctttccaaatgcagctt

SEQ ID NO: 2102 - DNA, 21 bp, Unknown
  Found in multiple species
agacccccgccttcctaaacc

SEQ ID NO: 2103 - DNA, 21 bp, Unknown
  Found in multiple species
agaccagccctaatcttacca

SEQ ID NO: 2104 - DNA, 21 bp, Unknown
  Found in multiple species
agaatttgtgcgccgtaatct

SEQ ID NO: 2105 - DNA, 21 bp, Unknown
  Found in multiple species
agaaaccggtccatcgggtgt

SEQ ID NO: 2106 - DNA, 21 bp, Unknown
  Found in multiple species
agaaaaattctgataaatcca

SEQ ID NO: 2107 - DNA, 21 bp, Unknown
  Found in multiple species
actttctaatattgataagtc

SEQ ID NO: 2108 - DNA, 21 bp, Unknown
  Found in multiple species
actttactgccaagcctagca

SEQ ID NO: 2109 - DNA, 21 bp, Unknown
  Found in multiple species
acttatcaatattagaaagtg

SEQ ID NO: 2110 - DNA, 21 bp, Unknown
  Found in multiple species
actgttggatcctttaggaaa

SEQ ID NO: 2111 - DNA, 21 bp, Unknown
  Found in multiple species
actgtcaaccgccatagtaag

SEQ ID NO: 2112 - DNA, 21 bp, Unknown
  Found in multiple species
actgccaagcctagcagcaat

SEQ ID NO: 2113 - DNA, 21 bp, Unknown
  Found in multiple species
actattaggaccctcttccca

SEQ ID NO: 2114 - DNA, 21 bp, Unknown
  Found in multiple species
actatggcggttgacagtgga

SEQ ID NO: 2115 - DNA, 21 bp, Unknown
  Found in multiple species
actaccatggagtccgatggc

SEQ ID NO: 2116 - DNA, 21 bp, Unknown
  Found in multiple species
actaccacccttttgctctaa

SEQ ID NO: 2117 - DNA, 21 bp, Unknown
  Found in multiple species
acggcgcacaaattcttcaac

SEQ ID NO: 2118 - DNA, 21 bp, Unknown
  Found in multiple species
acggaccttcccttttttgat

SEQ ID NO: 2119 - DNA, 21 bp, Unknown
  Found in multiple species
acgaagcaggctacttgcaat

SEQ ID NO: 2120 - DNA, 21 bp, Unknown
  Found in multiple species
acctttccaaatgcagctttc

SEQ ID NO: 2121 - DNA, 21 bp, Unknown
  Found in multiple species
accttgatcttgagctacatt

SEQ ID NO: 2122 - DNA, 21 bp, Unknown
  Found in multiple species
accttcccttttttgatctca

SEQ ID NO: 2123 - DNA, 21 bp, Unknown
  Found in multiple species
accttagagcaaaagggtggt

SEQ ID NO: 2124 - DNA, 21 bp, Unknown
  Found in multiple species
acctccaatgtagctcaagat

SEQ ID NO: 2125 - DNA, 21 bp, Unknown
  Found in multiple species
acctaccgccattgctgctag

SEQ ID NO: 2126 - DNA, 21 bp, Unknown
  Found in multiple species
acctaagggccagactgttgg

SEQ ID NO: 2127 - DNA, 21 bp, Unknown
  Found in multiple species
accggtttctgttaggaccaa

SEQ ID NO: 2128 - DNA, 21 bp, Unknown
  Found in multiple species
accggtccatcgggtgtttga

SEQ ID NO: 2129 - DNA, 21 bp, Unknown
  Found in multiple species
accggcgatgatactaccacc

SEQ ID NO: 2130 - DNA, 21 bp, Unknown
  Found in multiple species
accgctttggtcctaacagaa

SEQ ID NO: 2131 - DNA, 21 bp, Unknown
  Found in multiple species
accgccattgctgctaggctt

SEQ ID NO: 2132 - DNA, 21 bp, Unknown
  Found in multiple species
accgccatagtaagcacagga

SEQ ID NO: 2133 - DNA, 21 bp, Unknown
  Found in multiple species
acccttttgctctaaggtcca

SEQ ID NO: 2134 - DNA, 21 bp, Unknown
  Found in multiple species
accctcttcccagatatagcc

SEQ ID NO: 2135 - DNA, 21 bp, Unknown
  Found in multiple species
acccgatggaccggtttctgt

SEQ ID NO: 2136 - DNA, 21 bp, Unknown
  Found in multiple species
acccccgccttcctaaaccta

SEQ ID NO: 2137 - DNA, 21 bp, Unknown
  Found in multiple species
accattgagcgacttatcaat

SEQ ID NO: 2138 - DNA, 21 bp, Unknown
  Found in multiple species
accatggagtccgatggctat

SEQ ID NO: 2139 - DNA, 21 bp, Unknown
  Found in multiple species
accaggaaagctcatgagatc

SEQ ID NO: 2140 - DNA, 21 bp, Unknown
  Found in multiple species
accagccctaatcttaccagg

SEQ ID NO: 2141 - DNA, 21 bp, Unknown
  Found in multiple species
accacccttttgctctaaggt

SEQ ID NO: 2142 - DNA, 21 bp, Unknown
  Found in multiple species
accaagaccagccctaatctt

SEQ ID NO: 2143 - DNA, 21 bp, Unknown
  Found in multiple species
accaaagcggttgtcatgact

SEQ ID NO: 2144 - DNA, 21 bp, Unknown
  Found in multiple species
acattgcaagtagcctgcttc

SEQ ID NO: 2145 - DNA, 21 bp, Unknown
  Found in multiple species
acagtctggcccttaggttta

SEQ ID NO: 2146 - DNA, 21 bp, Unknown
  Found in multiple species
acagtcatgacaaccgctttg

SEQ ID NO: 2147 - DNA, 21 bp, Unknown
  Found in multiple species
acaggccttaatttaccattc

SEQ ID NO: 2148 - DNA, 21 bp, Unknown
  Found in multiple species
acagaaaccggtccatcgggt

SEQ ID NO: 2149 - DNA, 21 bp, Unknown
  Found in multiple species
acactttctaatattgataag

SEQ ID NO: 2150 - DNA, 21 bp, Unknown
  Found in multiple species
acacccgatggaccggtttct

SEQ ID NO: 2151 - DNA, 21 bp, Unknown
  Found in multiple species
acaaccgctttggtcctaaca

SEQ ID NO: 2152 - DNA, 21 bp, Unknown
  Found in multiple species
acaaaagagtgaagatgaact

SEQ ID NO: 2153 - DNA, 21 bp, Unknown
  Found in multiple species
aatttgtgcgccgtaatctcg

SEQ ID NO: 2154 - DNA, 21 bp, Unknown
  Found in multiple species
aattctgataaatccaaatgc

SEQ ID NO: 2155 - DNA, 21 bp, Unknown
  Found in multiple species
aatgtagctcaagatcaaggt

SEQ ID NO: 2156 - DNA, 21 bp, Unknown
  Found in multiple species
aatggtaaattaaggcctgtt

SEQ ID NO: 2157 - DNA, 21 bp, Unknown
  Found in multiple species
aatggcggtaggtaacataat

SEQ ID NO: 2158 - DNA, 21 bp, Unknown
  Found in multiple species
aatgcagctttcatactcaac

SEQ ID NO: 2159 - DNA, 21 bp, Unknown
  Found in multiple species
aatcttaccaggaaagctcat

SEQ ID NO: 2160 - DNA, 21 bp, Unknown
  Found in multiple species
aatccactgtcaaccgccata

SEQ ID NO: 2161 - DNA, 21 bp, Unknown
  Found in multiple species
aatccaaatgcgaaaggcagc

SEQ ID NO: 2162 - DNA, 21 bp, Unknown
  Found in multiple species
aatattgataagtcgctcaat

SEQ ID NO: 2163 - DNA, 21 bp, Unknown
  Found in multiple species
aagttgagtatgaaagctgca

SEQ ID NO: 2164 - DNA, 21 bp, Unknown
  Found in multiple species
aagttcatcttcactcttttg

SEQ ID NO: 2165 - DNA, 21 bp, Unknown
  Found in multiple species
aagtcgctcaatggtgaatac

SEQ ID NO: 2166 - DNA, 21 bp, Unknown
  Found in multiple species
aaggtctggaccttagagcaa

SEQ ID NO: 2167 - DNA, 21 bp, Unknown
  Found in multiple species
aaggtccagacctttccaaat

SEQ ID NO: 2168 - DNA, 21 bp, Unknown
  Found in multiple species
aagggtggtagtatcatcgcc

SEQ ID NO: 2169 - DNA, 21 bp, Unknown
  Found in multiple species
aagggccagactgttggatcc

SEQ ID NO: 2170 - DNA, 21 bp, Unknown
  Found in multiple species
aagggacactgctgcgactgg

SEQ ID NO: 2171 - DNA, 21 bp, Unknown
  Found in multiple species
aaggatctcagaaaaattctg

SEQ ID NO: 2172 - DNA, 21 bp, Unknown
  Found in multiple species
aaggatccaacagtctggccc

SEQ ID NO: 2173 - DNA, 21 bp, Unknown
  Found in multiple species
aaggaagaataatcctccacc

SEQ ID NO: 2174 - DNA, 21 bp, Unknown
  Found in multiple species
aaggaacaggccttaatttac

SEQ ID NO: 2175 - DNA, 21 bp, Unknown
  Found in multiple species
aagctgcatttggaaaggtct

SEQ ID NO: 2176 - DNA, 21 bp, Unknown
  Found in multiple species
aagctcatgagatcaaaaaag

SEQ ID NO: 2177 - DNA, 21 bp, Unknown
  Found in multiple species
aagcctagcagcaatggcggt

SEQ ID NO: 2178 - DNA, 21 bp, Unknown
  Found in multiple species
aagcaggctacttgcaatgta

SEQ ID NO: 2179 - DNA, 21 bp, Unknown
  Found in multiple species
aagattagggctggtcttggt

SEQ ID NO: 2180 - DNA, 21 bp, Unknown
  Found in multiple species
aagagtgaagatgaacttgcg

SEQ ID NO: 2181 - DNA, 21 bp, Unknown
  Found in multiple species
aagagggtcctaatagtttcc

SEQ ID NO: 2182 - DNA, 21 bp, Unknown
  Found in multiple species
aagagaatctgcagcaacatc

SEQ ID NO: 2183 - DNA, 21 bp, Unknown
  Found in multiple species
aagaccagccctaatcttacc

SEQ ID NO: 2184 - DNA, 21 bp, Unknown
  Found in multiple species
aagaatttgtgcgccgtaatc

SEQ ID NO: 2185 - DNA, 21 bp, Unknown
  Found in multiple species
aactattaggaccctcttccc

SEQ ID NO: 2186 - DNA, 21 bp, Unknown
  Found in multiple species
aacctaagggccagactgttg

SEQ ID NO: 2187 - DNA, 21 bp, Unknown
  Found in multiple species
aaccggtccatcgggtgtttg

SEQ ID NO: 2188 - DNA, 21 bp, Unknown
  Found in multiple species
aaccgctttggtcctaacaga

SEQ ID NO: 2189 - DNA, 21 bp, Unknown
  Found in multiple species
aaccgccatagtaagcacagg

SEQ ID NO: 2190 - DNA, 21 bp, Unknown
  Found in multiple species
aacagtctggcccttaggttt

SEQ ID NO: 2191 - DNA, 21 bp, Unknown
  Found in multiple species
aacaggccttaatttaccatt

SEQ ID NO: 2192 - DNA, 21 bp, Unknown
  Found in multiple species
aacagaaaccggtccatcggg

SEQ ID NO: 2193 - DNA, 21 bp, Unknown
  Found in multiple species
aacacccgatggaccggtttc

SEQ ID NO: 2194 - DNA, 21 bp, Unknown
  Found in multiple species
aaattctgataaatccaaatg

SEQ ID NO: 2195 - DNA, 21 bp, Unknown
  Found in multiple species
aaatgcagctttcatactcaa

SEQ ID NO: 2196 - DNA, 21 bp, Unknown
  Found in multiple species
aaatccaaatgcgaaaggcag

SEQ ID NO: 2197 - DNA, 21 bp, Unknown
  Found in multiple species
aaagttgagtatgaaagctgc

SEQ ID NO: 2198 - DNA, 21 bp, Unknown
  Found in multiple species
aaaggtctggaccttagagca

SEQ ID NO: 2199 - DNA, 21 bp, Unknown
  Found in multiple species
aaagggtggtagtatcatcgc

SEQ ID NO: 2200 - DNA, 21 bp, Unknown
  Found in multiple species
aaaggatccaacagtctggcc

SEQ ID NO: 2201 - DNA, 21 bp, Unknown
  Found in multiple species
aaaggaagaataatcctccac

SEQ ID NO: 2202 - DNA, 21 bp, Unknown
  Found in multiple species
aaagctgcatttggaaaggtc

SEQ ID NO: 2203 - DNA, 21 bp, Unknown
  Found in multiple species
aaagctcatgagatcaaaaaa

SEQ ID NO: 2204 - DNA, 21 bp, Unknown
  Found in multiple species
aaagagtgaagatgaacttgc

SEQ ID NO: 2205 - DNA, 21 bp, Unknown
  Found in multiple species
aaactattaggaccctcttcc

SEQ ID NO: 2206 - DNA, 21 bp, Unknown
  Found in multiple species
aaacctaagggccagactgtt

SEQ ID NO: 2207 - DNA, 21 bp, Unknown
  Found in multiple species
aaaccggtccatcgggtgttt

SEQ ID NO: 2208 - DNA, 21 bp, Unknown
  Found in multiple species
aaacacccgatggaccggttt

SEQ ID NO: 2209 - DNA, 21 bp, Unknown
  Found in multiple species
aaaattctgataaatccaaat

SEQ ID NO: 2210 - DNA, 21 bp, Unknown
  Found in multiple species
aaaagggtggtagtatcatcg

SEQ ID NO: 2211 - DNA, 21 bp, Unknown
  Found in multiple species
aaaagagtgaagatgaacttg

SEQ ID NO: 2212 - DNA, 21 bp, Unknown
  Found in multiple species
aaaaattctgataaatccaaa

SEQ ID NO: 2213 - DNA, 21 bp, Unknown
  Found in multiple species
aaaaaagggaaggtccgtagg

SEQ ID NO: 2214 - DNA, 22 bp, Amaranthus palmeri
gtgatattacctccaacacgat

SEQ ID NO: 2215 - DNA, 21 bp, Amaranthus palmeri
atagtaagcacaggatcggag

SEQ ID NO: 2216 - DNA, 21 bp, Amaranthus palmeri
ctttcaatccactgtcaaccg

SEQ ID NO: 2217 - DNA, 22 bp, Amaranthus palmeri
atcaagcgttcgaagacctcat

SEQ ID NO: 2218 - DNA, 21 bp, Amaranthus palmeri
cagcaatggcggtaggtaaca

SEQ ID NO: 2219 - DNA, 21 bp, Amaranthus palmeri
gcaattgcccgaatcctttta

SEQ ID NO: 2220 - DNA, 21 bp, Amaranthus palmeri
tagctcaatatcaaggtccta

SEQ ID NO: 2221 - DNA, 21 bp, Amaranthus palmeri
tcataagcaccctctatacac

The invention claimed is:

1. A method of plant control comprising: treating a plant with a composition comprising a non-transcribable polynucleotide and a transfer agent, wherein said non-transcribable polynucleotide is from 18 to about 700 nucleotides in length and is at least 85% identical or at least 85% complementary to a PPG oxidase gene sequence, or to an RNA transcript of said PPG oxidase gene sequence wherein said PPG oxidase gene sequence is selected from the group consisting of SEQ ID NOs: 1-5 and 8-71 and a polynucleotide fragment thereof, wherein said transfer agent conditions the surface of said plant for permeation by said non-transcribable polynucleotide, and whereby said plant's growth, development, or reproductive ability is suppressed or delayed or said plant is more sensitive to a PPG oxidase inhibitor herbicide as a result of said non-transcribable polynucleotide containing composition relative to a plant not treated with said composition.

2. The method as claimed in claim 1, wherein said transfer agent is an organosilicone surfactant composition or compound contained therein.

3. The method as claimed in claim 1, wherein said non-transcribable polynucleotide fragment is selected from the group consisting of sense ssDNA, anti-sense ssDNA, sense ssRNA, anti-sense ssRNA, dsRNA, dsDNA, and dsDNA/RNA hybrids.

4. The method as claimed in claim 1, wherein said plant is selected from the group consisting of *Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis,*

*Ambrosia trifida, Chenopodium album, Commelina diffusa, Conyza canadensis, Digitaria sanguinalis, Euphorbia heterophylla, Kochia scoparia*, and *Lolium multiflorum.*

5. The method as claimed in claim 1, wherein said composition further comprises said PPG oxidase inhibitor herbicide and said treating comprises external application to said plant with said composition.

6. The method as claimed in claim 5, wherein said composition further comprises one or more herbicides different from said PPG oxidase inhibitor herbicide.

7. The method as claimed in claim 1, wherein said composition comprises any combination of two or more of said non-transcribable polynucleotide or a fragment thereof and said treating comprises external application to said plant with said composition.

8. A composition comprising a non-transcribable polynucleotide and a transfer agent, wherein said non-transcribable polynucleotide is from 18 to about 700 nucleotides in length and is at least 85% identical or at least 85% complementary to a PPG oxidase gene sequence, or to an RNA transcript of said PPG oxidase gene sequence, wherein said PPG oxidase gene sequence is selected from the group consisting of SEQ ID NOs: 1-5 and 8-71 and a polynucleotide fragment thereof, wherein said transfer agent conditions the surface of a plant for permeation by said non-transcribable polynucleotide, and whereby said plant treated with said composition has its growth, development, or reproductive ability suppressed or delayed or said plant is more sensitive to a PPG oxidase inhibitor herbicide or mitosis inhibitor herbicide as a result of said non-transcribable polynucleotide containing composition relative to a plant not treated with said composition.

9. The composition of claim 8, wherein said transfer agent is an organosilicone composition.

10. The composition of claim 8, wherein said non-transcribable polynucleotide is selected from the group consisting of SEQ ID NOs: 72-145 and 151-1381.

11. The composition of claim 8, wherein said non-transcribable polynucleotide is selected from the group consisting of SEQ ID NOs: 1382-2213.

12. The composition of claim 8, further comprising said PPG oxidase inhibitor herbicide.

13. The composition of claim 12, wherein said PPG oxidase inhibitor herbicide is selected from the group consisting of acifluorfen-Na, bifenox, chlomethoxyfen, chlornitrofen, ethoxyfen-ethyl, fluoroglycofen-ethyl, fomesafen, halosafen, lactofen, oxyfluorfen, fluazolate, pyraflufen-ethyl, cinidon-ethyl, flumioxazin, flumiclorac-pentyl, fluthiacet-methyl, thidiazimin, oxadiazon, oxadiargyl, pyraclonil, flufenpyr-ethyl, azafenidin, carfentrazone-ethyl, Saflufenacil, sulfentrazone, pentoxazone, benzfendizone, butafenacil, pyrazogyl, and profluazol.

14. The composition of claim 12, further comprising a co-herbicide.

15. A method of reducing expression of a PPG oxidase gene in a plant comprising: external application to said plant of a composition comprising a non-transcribable polynucleotide and a transfer agent, wherein said non-transcribable polynucleotide is from 18 to about 700 nucleotides in length and is at least 85% identical or at least 85% complementary to a PPG oxidase gene sequence, or to an RNA transcript of said PPG oxidase gene sequence, wherein said PPG oxidase gene sequence is selected from the group consisting of SEQ ID NOs: 1-5 and 8-71 and a polynucleotide fragment thereof, wherein said transfer agent conditions the surface of said plant for permeation by said non-transcribable polynucleotide, and whereby said expression of said PPG oxidase gene is reduced relative to a plant in which the composition was not applied.

16. The method as claimed in claim 15, wherein said transfer agent is an organosilicone compound.

17. The method as claimed in claim 15, wherein said non-transcribable polynucleotide is selected from the group consisting of sense ssDNA, anti-sense ssDNA, sense ssRNA, anti-sense ssRNA, dsRNA, dsDNA, and dsDNA/RNA hybrids.

18. A method of identifying non-transcribable polynucleotides useful in modulating PPG oxidase gene expression when externally treating a plant comprising: a) providing a plurality of non-transcribable polynucleotides that are from 18 to about 700 nucleotides in length and are at least 85 percent identical or at least 85 percent complementary to a PPG oxidase gene sequence selected from the group consisting of SEQ ID NOs: 1-5 and 8-71; b) externally treating said plant with one or more of said non-transcribable polynucleotides and a transfer agent; and c) analyzing said plant or extract for modulation of PPG oxidase gene expression, wherein said transfer agent conditions the surface of said plant for permeation by said one or more of said non-transcribable polynucleotides, and whereby a plant treated with said one or more of said non-transcribable polynucleotides and said transfer agent has its growth, development, or reproductive ability suppressed or delayed or said plant is more sensitive to a PPG oxidase inhibitor herbicide or mitosis inhibitor herbicide as a result of said one or more of said non-transcribable polynucleotides and said transfer agent relative to a plant not treated with said one or more of said non-transcribable polynucleotides and said transfer agent.

19. The method as claimed in claim 18, wherein said plant is selected from the group consisting of *Amaranthus albus, Amaranthus graecizans, Amaranthus hybridus, Amaranthus lividus, Amaranthus palmeri, Amaranthus rudis, Amaranthus spinosus, Amaranthus thunbergii, Amaranthus viridis, Ambrosia trifida, Chenopodium album, Commelina diffusa, Conyza canadensis, Digitaria sanguinalis, Euphorbia heterophylla, Kochia scoparia*, and *Lolium multiflorum.*

20. The method as claimed in claim 18, wherein said PPG oxidase gene expression is reduced relative to a plant not treated with said one or more of said non-transcribable polynucleotides and said transfer agent.

21. The method as claimed in claim 18, wherein said transfer agent is an organosilicone compound.

22. An agricultural chemical composition comprising an admixture of a non-transcribable polynucleotide, a PPG oxidase inhibitor herbicide, and a co-herbicide, wherein said non-transcribable polynucleotide is from 18 to about 700 nucleotides in length and is at least 85% identical or at least 85% complementary to a portion of a PPG oxidase gene sequence, or to a portion of an RNA transcript of said PPG oxidase gene sequence, wherein said PPG oxidase gene sequence is selected from the group consisting of SEQ ID NOs: 1-5 and 8-71 and a polynucleotide fragment thereof, and whereby a plant treated with said composition has its growth, development, or reproductive ability suppressed or delayed or said plant is more sensitive to said PPG oxidase inhibitor herbicide or a mitosis inhibitor herbicide as a result of said non-transcribable polynucleotide containing composition relative to a plant not treated with said composition.

23. The agricultural chemical composition of claim 22, wherein said co-herbicide is selected from the group consisting of amide herbicides, arsenical herbicides, benzothiazole herbicides, benzoylcyclohexanedione herbicides, benzofuranyl alkylsulfonate herbicides, cyclohexene oxime herbicides, cyclopropylisoxazole herbicides, dicarboximide herbicides, dinitroaniline herbicides, dinitrophenol herbicides, dithiocarbamate herbicides, glycine herbicides, halogenated aliphatic herbicides, imidazolinone herbicides, inorganic herbicides, nitrile herbicides, organophosphorus herbicides, oxadiazolone herbicides, oxazole herbicides, phenoxy herbicides, phenylenediamine herbicides, pyridazine herbicides, pyridazinone herbicides, pyridine herbicides, pyrimidinediamine herbicides, pyrimidinyloxybenzylamine herbicides, quaternary ammonium herbicides, thiocarbamate herbicides, thiocarbonate herbicides, thiourea herbicides, triazine herbicides, triazinone herbicides, triazolone herbicides, triazolopyrimidine herbicides, uracil herbicides, and urea herbicides.

24. An agricultural chemical composition comprising an admixture of a non-transcribable polynucleotide, a PPG oxidase inhibitor herbicide, and a pesticide, wherein said non-transcribable polynucleotide is from 18 to about 700 nucleotides in length and is at least 85% identical or at least 85% complementary to a portion of a PPG oxidase gene sequence, or to a portion of an RNA transcript of said PPG oxidase gene sequence, wherein said PPG oxidase gene sequence is selected from the group consisting of SEQ ID NOs: 1-5 and 8-71 and a polynucleotide fragment thereof, and whereby a plant treated with said composition has its growth, development, or reproductive ability suppressed or delayed or said plant is more sensitive to said PPG oxidase inhibitor herbicide or a mitosis inhibitor herbicide as a result of said non-transcribable polynucleotide containing composition relative to a plant not treated with said composition.

25. The agricultural chemical composition of claim 24, wherein said pesticide is selected from the group consisting of insecticides, fungicides, nematicides, bactericides, acaricides, growth regulators, chemosterilants, semiochemicals, repellents, attractants, pheromones, feeding stimulants, and biopesticides.

26. The method of claim 1, wherein said non-transcribable polynucleotide is an RNA polynucleotide.

27. The composition of claim 8, wherein said non-transcribable polynucleotide is an RNA polynucleotide.

28. The method of claim 1, wherein said PPG oxidase gene sequence is selected from the group consisting of SEQ ID NOs: 1-5, 8, and 10-71 and a polynucleotide fragment thereof.

29. The composition of claim 8, wherein said PPG oxidase gene sequence is selected from the group consisting of SEQ ID NOs: 1-5, 8, and 10-71 and a polynucleotide fragment thereof.

* * * * *